United States Patent 9,834,782 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 5

SEQ ID NO: 10076 - protein, 273 aa, Primula obconica
MASSVCASSAIAAVSLSSPSSQKSGSIVGATKASFVGGKRLRVNKYTSSAGARTRSLNVRAVAADPERPLWFPGSTPPEWLDGSLPGDFGFDPLGLGSDPETLKWNVQSELVHCRWAMLGAAGIFIPEFLTKIGILNTPSWYTAGEQEYFTDTTTLFIVELIFIGWAEGRRWADILEPGSVNTDPIFPNNKLTGTDVGYPGGLWFDPLGWGNASPEKLKELRTKEIKNGRLAMLAVIGAWFQANYTGTGPIDNLFAHLSDPGHATIFAAFSSK

SEQ ID NO: 10077 - protein, 97 aa, Phalaenopsis aphrodite
MACVCAPSAVAAVAIVSSNVQKNGNGLCATKEHFLVGKGVRQSTAVVAGKRRSFSVSAAAIERPLWFPGSTPPPWLDGSLPGDFGSIHLALDRTQRA

SEQ ID NO: 10078 - protein, 270 aa, Beta vulgaris
MASLCASSASTAICASSHSSQKKGSVLGATKASFLGGKKLRDTKYKAPTASKSLSVSAAAAEPERPIWFPGSTPPPWLDGSLPGDFGFDPLGFGSDPETLKWMVQSELVHCRWAMLGAAGIFIPEFLTKLGILNTPSWYTAGELEYFTDTTTLFIIEMILIGWAEGRRWADILKPGCVNTDPIFPNNKLTGTDVGYPGGLWFDPLGWGSGSPQKTKELRTKEIKNGRLAMLAVMGAWFQHIYTGTGPIDNLFAHLADPGHATIFAAFTPK

SEQ ID NO: 10079 - protein, 91 aa, Gossypium hirsutum
MATVCASSAVAAVAISSPSSQRSGSVVRTTKASFLTGKKLRSVKKYTKPAAVRTVPVCAVADPDRPLWFPGSTPPPMARWQPPWRLRFLIL

SEQ ID NO: 10080 - protein, 271 aa, Eschscholzia californica
MASFCASPAVAAVAISSSSQKSSGTILGATKASFLVGRKLTQRKSLTSSPLSRSFTVTAAATDAERPLWFPGSTPPPWLDGSLPGDFGFDPLGLSSDPESLRWNQQAELVHCRWAMLGAAGIFIPEFLTKIGILNTPSWYTAGEQEYFTDTTTLFIVELIFIGWAEGRRWADILKPGSVNTDPIFPNNKLTGTDVGYPGGLWFDPLGWGTASPAKLKELRTKEIKNGRLAMLAVMGAWFQAIYTGTGPIDNLFAHLADPGHATIFQAFAPK

SEQ ID NO: 10081 - protein, 262 aa, Mesembryanthemum crystallinum
MASVCASSATTAVSISSPSSTRASFLGGKKVRVAKYRAPVGSTKSFSVSAVAAEPDRPLWFPGSTPPEWLDGSLPGDFGFDPLGLGSDPETLRWMVQAEIVHSRWAMLGAAGIFIPEFLTKIGILNTPSWYTAGEQEYFTDTTTLFVVELVLIGWAEGRRWADILNPGCVNTDPIFPNNKLTGTDVGYPGGLWFDPLGWGSGSAQKVKELRTKEIKNGRLAMLAVMGAWFQHIYTGTGPIDNLFAHLADPGHATIFAAFSPK

SEQ ID NO: 10082 - protein, 266 aa, Phalaenopsis aphrodite
CVCAPSAVAAVAIVSSNVQKNGNGLCATKEHFLVGKRVRQSTAVVAGKRRSFSVSAAAIERPLWFPGSTPPPWLDGSLPGDFGFDPLGLGSDPESLRWNVQSELVHCRWAMLGAAGIFVPEFLTKIGILNTPSWYSAGELEYFTDTTTLFIIELILIGWAEGRRWADIIKPGCVNTDPIFPNNKLTGTDVGYPGGLWFDPLGWGSGSPERVKELRTKEIKNGRLAMLAVIGAWFQHIYTGTGPIDNLFAHLADPGHATIFAAFTPK

SEQ ID NO: 10083 - protein, 275 aa, Tamarix hispida
MASVCASSAMAAASISSPSSQKTSNVVGATKASFLGGKKLRVTKCRRPDAAAQSKSSSTVSAAAADPAERPLWFPGSTPPAWLDGSLPGDFGFDPLGLGSDPETLRWMVQAELVHCRWAMLGAAGIFIPELLTKIGILNTPSWYTAGEQEYFTDTTTLFVIELILIGWAEGRRWADILKPGCVNTDPIFPNNKLTGTDVGYPGGLWFDPLGWGSGSPEKVRELRTKEIKNGRLAMLAVMGAWFQHIYTGVGPIDNLFAHLADPGHATIFAAFSPK

SEQ ID NO: 10084 - protein, 257 aa, Flaveria ramosissima
VAFSSPSSQKSGSIVGSTKASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10085 - protein, 245 aa, Acacia harpophylla
MASACASSAVASAAISTPSSQKNGIILGSRTSFLSGRKLKVNKFTVGGRSVSSKVCAVAADPDRPLWFPGSTPPPWLDGSLPGDFGFDPLGLGSDPESLRWNVQAELVHCRWAMLGAAGIFIPEFLTKIGILNTPSWYTAGELEYFTDTTTLFIIELIFIGWAEGRRWADILKPGSVNTDPIFPNNKLTGTDVGYPGGLWFDPLGWGSGSPEKVKELRTKEIKNGRLAMLAVMGAWFQHIYTGTG

SEQ ID NO: 10086 - protein, 263 aa, Utricularia gibba
MAASACASSAIAAVAFSSPSSSTKTSFFGSRKLRGGGKSATQTSSRSVAVCAAADPDRPLWFPGSTPPPWLDGSLPGDFGFDPLGLGSDPETLKWNQQSEIVHCRWAMLGAAGIFIPEFLTKIGVLNTPSWYTAGEQEYFTDTTTLFIIELILIGWAEGRRWADIIKPGSVNTDPIFPNNKLTGTDVGYPGGLWFDPLGWGSGSPEKVKEIRTKEIKNGRLAMLAVIGAWFQHIYTGTGPIDNLFAHLADPGHATIFAAFTPK

SEQ ID NO: 10087 - protein, 266 aa, Allium cepa
MASVCASSSAIASIASKKSGSASISASKASFLGGSKKFRTSKSSATTGKKSLQVTAAAAERPLWFPGSTPPEWLDGSLPGDFGFDPLGLGSDPESLRWNAQAELVHCRWAMLGAAGIFIPEFLTKIGILNTPSWYTAGEQEYFTDKTTLFIVELILIGWAEGRRWADIIKPGCVNTDPIFPNNKLTGTDVGYPGGLWFDPLGWGSGSPEKIKELRLKEIKNGRLAMLAVMGAWFQANYTGTGPIDNLFAHLADPGHATIFAAFTPK

SEQ ID NO: 10088 - protein, 270 aa, Fagopyrum esculentum
MASVCASSTMVSAPISSQKTSTVVGITKASFLGGKKLRVTKFCAPGSSTAKPSFAVRAVASEPDRPLWFPGSNPPEWLDGSLPGDFGFDPLGFGSDPETLRWMVQSEIVHARWAMLGAAGIFIPEFLTKIGILNTPSWYTAGELEYFTDTTTLFVIELVLIGWAEGRRWADIIKPGCVNTDPIFPNNKLTGTDVGYPGGLWFDPLGWGSGSPQKVKELRTKEIKNGRLAMLAVFGAWFQHIYTGTGPIDNLFAHLADPGHATIFAAFAPK

SEQ ID NO: 10089 - protein, 256 aa, Unknown
  Sequence found in Organisms: Brassica napus, Brassica juncea, Brassica rapa
MASLCASSAIAAISSPGFLGGKKLRLNKKLNVPAVSRSGTSVRAVAADPDRPIWFPGSTPPEWLDGSLPGDFGFDPLGLSSDPDSLKWNAQAELVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10090 - protein, 256 aa, Brassica juncea
MASLCASSAIAAISAPSFLGGKKLRLNKKLSVPAGSKSAATVRAVAADPERPIWFPGSTPPEWLDGSLPGDFGFDPLGLSSDPDSLKWNVQAEIVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10091 - protein, 256 aa, Brassica oleracea
MASLCASSAIAAISSPGFLGGKKLRLNKKLNVPTVSRSGTSVRAVAADPDRPIWFPGSTPPEWLDGSLPGDFGFDPLGLSSDPDSLKWNAQAELVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10092 - protein, 204 aa, Flaveria ramosissima
AFSSPSSQKSGSIVASTKATFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIVELIFIGWAEGRRWADIIKPGCVNTDPIFPNNKLTGTDVGYPGGLWFDPLGWGAVRLQSSRS

SEQ ID NO: 10093 - protein, 256 aa, Brassica juncea
MASLCASSAIAAISSPGFLGGKKLRLNKKLSVPAVFRSAASVRAVAADPDRPIWFPGSTPPEWLDGSLPGDFGFDPLGLSSDPDSLKWNAQAELVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10094 - protein, 256 aa, Brassica juncea
MASLCASSAIAAISSPGFLGGKKLRLNKKLSVPAVSRSAASVRAVAADPDRPIWFPGSTPPEWLDGSLPGDFGFDPLGLSSDPDSLKWNAQAELVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10095 - protein, 256 aa, Unknown
  Sequence found in Organisms: Brassica napus, Triticum aestivum
MASLCASSAIAAISSPSFLAGKKLRLNKKLSVPAVSKSAASVRAVAADPERPIWFPGSTPPEWLDGSLPGDFGFDPLGLSSDPESLKWNVQAEIVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10096 - protein, 256 aa, Unknown
  Sequence found in Organisms: Thellungiella halophila, Eutrema halophilum
MASLCASSAIAAISSPSFLGGKKLRLKNKASVPAVSRSAALVRAVAADPERPIWFPGSTPPEWLDGSLPGDFGFDPLGLSSDPDSLKWNAQAELVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10097 - protein, 256 aa, Eutrema parvulum
MASLCASSAIAAISSPSFLGGKKLRLKKNLSVPAVSRSAASVRAVAADPERPIWFPGSTPPEWLDGSLPGDFGFDPLGLSSDPDSLKWNAQAELVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10098 - protein, 251 aa, Flaveria ramosissima
SSQKSGSIVGSTKASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIVELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10099 - protein, 252 aa, Flaveria ramosissima
PSSQKSGSIVGSTKASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10100 - protein, 251 aa, Ambrosia trifida
QVHRRVDQLLDHKSLFSCGKKLRVSKVGAPSGSRSFGTVCVAATPTRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGKGSPAKLKELRTKEIKNGRLAMLAVMGAWFQAIYTGTGPIDNLFAHLADPGHATIFAAFKG

SEQ ID NO: 10101 - protein, 181 aa, Flaveria ramosissima
EKWIYCCINKGFFSWWEELKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIVELIFIGWAEGRRWADIIKPGCVNTDPIFPQQQANWDRCWLPGWAMV

SEQ ID NO: 10102 - protein, 270 aa, Guizotia abyssinica
PTQILNTQTKTMACASSAIAAVAFSSPTTTTKASFLGGKKLRVNKLGAPTGSRSFGTVCAVADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIVELIFIGWAEGRRWADILKPGSVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10103 - protein, 257 aa, Arabidopsis lyrata
MASSLCASSAIAAISSPSFLGGKKLRLKKKLTVPAVSRPDASVRAVAADPDRPIWFPGSTPPEWLDGSLPGDFGFDPLGLSSDPDSLKWNVQAELVHCRWAMLGAAGIFIPEFLTKIGILNTPSWYTAGEQEYFTDKTTLFVVELILIGWAEGRRWADIIKPGSVNTDPVFPNNKLTGTDVGYPGGLWFDPLGWGSGSPAKLKELRTKEIKNGRLAMLAVMGAWFQHIYTGTGPIDNLFAHLADPGHATIFAAFTPK

SEQ ID NO: 10104 - protein, 271 aa, Allium cepa
MASVCASSSAIASIARQLILFKKSGSASISVSKASFLGGSKKFRASKSSATSGKKSLQVSAAAAERPLWFPGSTPPEWLDGSLPGDFGFDPLGLGSDPESLKWNAQAELVHCRWAMLGAAGIFIPEFLTKIGILNTPSWYTAGEQEYFTDKTTLFIVELILIGWAEGRRWADIIKPGCVNTDPIFPNNKLTGTDVGYPGGLWFDPLGWGSGSPEKIKELRLKEIKNGRLAMLAVMGAWFQANYTGTGPIDNLFAHLADPGHATIFAAFTPK

SEQ ID NO: 10105 - protein, 95 aa, Allium cepa
MASVCASSSAIASIASKKSGSASISVSKASFLGGSKKFRASKSSATSGKKASKSQQLQQKGHFGFQAALLQNGSMAAFQETLDLILLVLDLTQKA

SEQ ID NO: 10106 - protein, 204 aa, Brassica napus
MASLCASSAIAAISSPSFLGGKKLRLNKKLSVPAVSKSAASVRAVAADPERPIWFPGSTPPEWLDGSLPGDFGFDPLGLSSDPESLKWNVQAEIVHCRWAMLGAAGIFIPEFLTKIGILNTPSWYTAGEQEYFTDKTTLFVVELILIGWAEGRRWADIIKPGSVNTDPIFPNNKLTGTDVGYPGWGYGSTRWVGDPVARLRSRS

SEQ ID NO: 10107 - protein, 256 aa, Unknown
  Sequence found in Organisms: Brassica napus, Brassica oleracea, Raphanus sativus
MASLCASSAIAAISSPSFLGGKKLRLNKKLSVPAVSKSAASVRAVAADPERPIWFPGSTPPEWLDGSLPGDFGFDPLGLSSDPDSLKWNVQAEIVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10108 - protein, 266 aa, Valeriana officinalis
MASACTAIVAAAFSSSSCQKNGAVAKSCFLGGKKLRLNVSKCKSVSRSFGTTTVCTLADPERPIWFPGSTPPAWLDGSLPGDFGFDPLGLGSDPETLKWNVQAEIVHCRWAMLGAAGIFIPEFLTKIGILNTPSWYTAGEQEYFTDKTTLFIVELIFIGWAEGRRWADIIKPGCVNTDPIFPNNKLTGTDVGYPGGLWFDPLGWGSGSPAKLKELRTKEIKNGRLAMLAVMGAWFQANYTGTGPIDNLFAHLADPGHATIFAAFTP

SEQ ID NO: 10109 - protein, 252 aa, Flaveria ramosissima
MASTACASSAIAAVAFSSPSSQKSGCTVGSTKASFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTAHRQPV

SEQ ID NO: 10110 - protein, 261 aa, Ambrosia trifida
CSCLPSLLQVHRRVDHKGFFSCGKKLRVSKVGAPSGSRSFRAVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNIDPIFPNNKLTGTDVGYPGGLWFDPLGWGTGSPAKLKELRTKEIKNGRLAMLAVMGAWFQAIYTGTGPLTTCLLTLLTRVMPPSSLHSRANAYGRT

SEQ ID NO: 10111 - protein, 250 aa, Cirsium arvense
SQKSGSIVGSTKASFLGGKKLRVSKFSAPTGARSFGTVCVAADPDRPLWFPGSTPPEWLDGSLPGDFGFDPLGLGSDPDTLKWNQQAELVHCRWAMLGAAGIFIPEFLTKIGILNTPSWYTAGEQEYFTDKTTLFIVELIFIGWAEGRRWADILNPGCVNTDPIFPNNKLTGTDVGYPGGLWFDPLGWGSGSPQKLKELRTKEIKNGRLAMLAVMGAWFQAIYTGTGPIDNLFAHLADPGHATIFAAFKG

SEQ ID NO: 10112 - protein, 251 aa, Flaveria ramosissima
SSQKSGSIVGSTKASFLGGKKLRVGKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10113 - protein, 263 aa, Oryza sativa
MALVSASSSTTAVAALPGAARASSFLGGAGRSGRLLLRQAESSSARASFAVRAAAPDRPIWFPGSTPPPWLDGSLPGDFGFDPLGLGSDPESLRWNVQAELVHCRWAMLGAAGIFIPEFLTKIGILNTPSWYTAGEQQYFTDTTTLFIIELILIGWAEGRRWADIIKPGCVNTDPIFPNNKLTGTDVGYPGGLWFDPLGWGTGSPEKIKELRTKEIKNGRLAMLAVMGAWFQAEYTGTGPIDNLFAHLADPGHATIFQAFTPK

SEQ ID NO: 10114 - protein, 257 aa, Arabidopsis thaliana [sequence omitted]

SEQ ID NO: 10115 - protein, 293 aa, Allium cepa
MASVCASSSAIASIARQLILFKKSGSASISVSKASFLGGSKKFRASKSSATSGKKSLQVSAAAAERPLWFPGSTPPEWLDGSLPGDFGFDPLGLGSDPESLKWNAQAELVHCRWAMLGAAGIFIPEFLTKIGILNTPSWYTAGEQEYFTDKTTLFIVELILIGWAEGRRWADIIKPGCVNTDPIFPNNKLTGTDVGYPGGLWFDPLGWGSGSPEKIKELRLKEIKNGRLAMLAVMGAWFQANYTGTGPIDNLFAHLADPGHALSSLLSLPSERKMWNMDYQLWRKLCKIWLGW

SEQ ID NO: 10116 - protein, 256 aa, Unknown
  Sequence found in Organisms: Brassica napus, Brassica juncea, Brassica rapa
MASLCASSAIAAISSPSFLCGKKLRLNKKLSVAAVSKSAASVRAVAADPERPIWFPGSTPPEWLDGSLPGDFGFDPLGLSSDPDSLKWNVQAEIVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10117 - protein, 256 aa, Brassica juncea
MASLCASSAIAAISSPGFLGGKKLRLNKKLSVPAVSKSAASVRAVAADPDRPIWFPGSTPPEWLNGSLPGDFGFDPLGLSSDPDSLKWNAQAELVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10118 - protein, 253 aa, Brassica juncea
LCASSAIAAISAPSFLGGKKLRLNKKLSVPAGSKSAATVRAVAADPERPIWFPGSTPPEWLDGSLPGDFGFDPLGLSSDPDSLKWNVQAEIVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10119 - protein, 272 aa, Papaver somniferum
MASVCTSSAIAAVAISSSSQKSSGTTLGATKASFLVGQKLRQTSNALVKASRSTFSVSAAAATDSERPLWFPGSTPPAWLDGSLPGDFGFDPLGLSSDPESLKWNQQAELVHCRWAMLGAAGIFIPEFLTKIGILNTPSWYTAGEQEYFTDTTTLFVIELVLIGWAEGRRWADILKPGSVNTDPVFPNNKLTGTDVGYPGGLWFDPLGWGSASPEKLKELRTKEIKNGRLAMLAVMGAWFQAQYTGVGPIDNLFAHLADPGHATIFQAFTPQ

SEQ ID NO: 10120 - protein, 256 aa, Raphanus sativus
  misc_feature (27)..(27): Xaa can be any naturally occurring amino acid
MASLCASSAITAISSPGFLGGKKLRLXKKLSVPAGSRSAASVRAAAADPDRPIWFPGSTPPEWLDGSLPGDFGFDPLGLSSDPDSLKWNAQAELVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10121 - protein, 287 aa, Allium cepa
MASVCASSSAIASIASKKSGSASISVSKASFLGGSKKFRASKSSATSGKSLQVSAAAAERPLWFPGSTPPEWLDGSLPGDFGFDPLGLGSDPESLKWNAQAELVHCRWAMLGAAGIFIPEFLTKIGILNTPSWYTAGEQEYFTDKTTLFIVELILIGWAEGRRWADIIKPGCVNTDPIFPNNKLTGTDVGYPGGLWFDPLGWGSGSPEKIKELRLKEIKNGRLAMLAVMGAWFQANYTGTGPIDNLFAHLADPGHATIFAAFTPSERKMWNMDYQLWRKLCKIWLGW

SEQ ID NO: 10122 - protein, 277 aa, Centaurea maculosa
  misc_feature (276)..(276): Xaa can be any naturally occurring amino acid
MASTAYASSAIAAAAFSSPSSQKSGSIVGSTKASFLGGKKLRVSKFSAPTGARSFGTVCVAADPDRPLWFPGSTPPEWLDGSLPGDFGFDPLGLGSDPDTLKWNQQAELVHCRWAMLGAAGIFIPEFLTKIGILNTPSWYTAGEQEYFTDKTTLFIVELIFIGWAEGRRWADILNPGCVNTDPIFPNNKLTGTDVGYPGGLWFDPLGWGSGSPQKLKELRTKEIKNGRLAMLAVMGAWVPSHLHWNGPLTLFAHLLTRSRHILRIRLIAEDAGMKXG

SEQ ID NO: 10123 - protein, 254 aa, Brassica juncea
MASLCASSAIAAISSPSFLGGKKLRLNKKLSVPAVSKSAVRAVAADPERPIWFPGSTPPEWLDGSLPGDFGFDPLGLSSDPDSLKWNVQAEIVHCRWAMLGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10124 - protein, 246 aa, Flaveria ramosissima
RNYCWINKGFFLGGKKLKVSKLGAPSGSRSFATVSAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10125 - protein, 269 aa, Flaveria ramosissima
MASTACALLPLQLLLSLLQLHRRVVLLLDHKASFLGGKKLRVSKVGAPSGSRSFGTVCVAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIVELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10126 - protein, 258 aa, Panicum virgatum
MALVSASSSSTAVAALPRNGQRSLSFLGGKTLLRQAEAARPSFAVRAAADPDRPIWFPGSTPPPWLDGSLPGDFGFDPWGLGSDPESLRWNVQAELVHCRWAMLGAAGIFIPEFLTKIGILNTPFWYTAGEQQYFTDTTTLFIIELILIGWAEGRRWADIIKPGSVNTDPIFPNNKLTGTDVGYPGGLWFDPLGWGSGSPEKIKELRTKEIKNGRLAMLAVMGAWFQAEYTGTGPIDNLFAHLADPGHATIFQAFTPK

SEQ ID NO: 10127 - protein, 256 aa, Brassica napus
MASLCASSAIAAISSPSFLCGKKLRLNKKLSVAAVSKSAASVRAVAADPERPIWFPGSTPPEWLDGSLPGDFGFDPLGLSSDPDSLKWNVQAEIVHCRWAMLGAAGNFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10128 - protein, 272 aa, Papaver somniferum
MASVCTSSAIAAVAISSSSQKSSGTTLGATKASFLVGQKFRQTSSAFVKASRSTFSVSAAAATDSERPLWFPGSTPPAWLDGSLPGDFGFDPLGLSSDPESLKWNQQAELVHCRWAMLGAAGIFIPEFLTKIGILNTPSWYTAGEQEYFTDTTTLFVIELVLIGWAEGRRWADILKPGSVNTDPVFPNNKLTGTDVGYPGGLWFDPLGWGSASPEKLKELRTKEIKNGRLAMLAVMGAWFQAQYTGVGPIDNLFAHLADPGHATIFQAFTPQ

SEQ ID NO: 10129 - protein, 254 aa, Brassica juncea
MASLCASSAIAAISSPSFLGGKKLRLNKKLSVPAVSKSAVRAVAADPERPIWFPGSTPPEWLDGSLPGDFGFDPLGLSSDPDSLKWNVQAEIVHCRWAMPGAAGIFIPEFLTKIGILNTPSWYTAGEQEYFTDKTTLFVVELILIGWAEGRRWADIIKPGSVNTDPIFPNNKLTGTDVGYPGGLWFDPLGWGSGSPAKIKELRTKEIKNGRLAMLAVMGAWFQHIYTGTGPIDNLFAHLADPGHATIFAAFTPK

SEQ ID NO: 10130 - protein, 247 aa, Cichorium intybus
SGSFVGSTKASFLGGKNLRVSKFTAPTRARSVGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIVELIFIGWAEGRRWADILKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10131 - protein, 263 aa, Sorghum bicolor
MALVSASSSSTTAVAALPRNGQQRASSTSFLGGKTLLRQATEAARPSFAVRAAADPDRPIWFPGSTPPPWLDGSLPGDFGFDPWGLGSDPESLRWNVQAELVHCRWAMLGAAGIFIPEFLTKIGILNTPFWYTAGEQQYFTDTTTLFIIELILIGWAEGRRWADIIKPGSVNTDPIFPSNKLTGTDVGYPGGLWFDPLGWGSGSPEKIKELRTKEIKNGRLAMLAVMGAWFQAEYTGTGPIDNLFAHLADPGHATIFQAFTPK

SEQ ID NO: 10132 - protein, 257 aa, Triticum aestivum
MALVSSSSAATAVAALPSNGLAGARSSFLGAAGKAAAASRASFAVRAAAPERPIWFPGSTPPPWLDGSLPGDFGFDPWGLGSDPESLRWNVQAELVHCRWAMLGAAGIFIPELLTKIGILNTPSWYTAGEQEYFTDTTTLFIVELILIGWAEGRRWADIIKPGCVNTDPIFPNNKLTGTDVGYPGGLWFDPLGYGTGSPEKLKELRTKEIKNGRLAMLAVMGAWFQAEYTGTGPIDNLFAHLADPGHATIFRAFAPK

SEQ ID NO: 10133 - protein, 270 aa, Musa acuminata
MASLCASSSAVAAVARSRKNGAAAVAATKASFLGGRKLRQGKRAARAQTARRELSVSAAAAPERPLWFPGSTPPPWLDGSLPGDFGFDPLGLGSDPESLRWNQQAEIVHCRWAMLGAAGIFIPELLTKIGILNTPSWYTAGQLQYFTDTTTLFVIELILIGWAEGRRWADIIKPGCVNTDPIFPNNKLTGTDVGYPGGFWFDPLGWGSGSPEKVKELRTKEIKNGRLAMLAVMGAWFQAIYTGTGPIDNLFAHLADPGHATVFSVSRFHW

SEQ ID NO: 10134 - protein, 245 aa, Ipomoea batatas
MASACAASSTIAAAASSSPSSQTKASFLSGRKLRVSKYSAPATSRSFTVCATADPNRPLWFPGSTPPPWLDGSLPGDFGFDPLGLASDPESLKWNQQAEIVHCRWAMLGAAGIFIPEFLTKIGILNTPSWYTAGEQEYFTDTTTLFVIELILIGWAEGRRWADIIKPGCVNTDPIFPNNKLTGTDVGYPGGLWFDPLGWGSGSPEKIKELRTREIKNGRLAMLAVMGAWFQHIYTGTGPMDNLFA

SEQ ID NO: 10135 - protein, 256 aa, Ambrosia trifida
CSCCLLLSKFTEDGSQRFFLVEELRVSKVSAPSGSRSFGTVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPLTTCLLTLLTRLNCHYLRCIQGLMH

SEQ ID NO: 10136 - protein, 101 aa, Flaveria ramosissima
MERTGGLVHCRWAMLGAAGIFIPEFLTKIGILNTPSWYTAGEQEYFTDKTTLFIIKLIFIGWAEGRRWADIIKPGCVNTDPIFPNNKLTGTGCWLPGRAMV

SEQ ID NO: 10137 - protein, 255 aa, Triticum aestivum
MALVSSSSATAVAALPSNGLAGARSSFLGAAGKAAGSRASFAVRAAAPERPIWFPGSTPPPWLDGSLPGDFGFDPWGLGSDPESLRWNVQAELVHCRWAMLGAAGIFIPELLTKIGILNTPSWYTAGEQEYFTDTTTLFIVELILIGWAEGRRWADIIKPGCVNTDPIFPNNKLTGTDVGYPGGLWFDPLGYGTGSPEKLKELRTKEIKNGRLAMLAVMGAWFQAEYTGTGPIDNLFAHLADPGHATIFRAFAPK

SEQ ID NO: 10138 - protein, 248 aa, Glycine max
MASLQHPTASLQSKHVLIPRNTLTQKPILNLSSLPGTTFTPLKLKFFSGGAVRRSTGASGARMSATAASSYAAALADVAAANNTLDATTADIEKIDEIFSEAQVSDYFANPTLAVEKKRKLIDEIAESSGFQPHTRNFLYILVDAQRIDLINEIAKEFELVYNSLTDTELAVVTSVVKLESQHLAQIAKQVQKLTGTKNVRIKTLLDPSLVAGFTVRYSGSKLIDMSVRKQLEDIAAQLELGDISLAV

SEQ ID NO: 10139 - protein, 251 aa, Cajanus cajan
MASLQHPTASLQSKHALIPRNSLAQKPILNISLPGTTFTPLKLKFASFSLSATRRSQGASGARMSATAASSYAAALADVAFSNNTLDATTSDIEKIDEIFADPKVSDYFADPTLAVEQKRKLVDEIAESSGFQPHTRNFLYILVDAQRIDLINEIAKEFELVYNALTDTELAVVTSVVKLESQHLAQIAKQVQKLTGAKNVRIKTLLDPALVAGFTVRYGNSGSKLIDMSVRKQLEDIAAQLELGDISLAV

SEQ ID NO: 10140 - protein, 247 aa, Phaseolus coccineus
MASLQHPTASLQSKHVLIPGKPLAQKPTHTVSLPRSTFSALKLKLAAATRRSNGAAGARMSATAASSYASALADVASANNTLDATTSDIEKIDELFSDPRVSDFFADPTLEVEKKRQVVDEIAESSGFQPHTRNFLYILVDAQRIDLINEIAKEFDLVYNKLTETELAVVTSVVKLESQHLTQIAKQVQKLTGAKNVRIKTLLDPSLVAGFTVRYGNSGSKLIDMSVRKQLEDIAAQLELSDLTLAV

SEQ ID NO: 10141 - protein, 247 aa, Vigna unguiculata
MASLQHPTASLQSKHVLIPGKSLSQKPALTVSFPRSTFSALKLKLAAATRRSNGAAGARMSATVASSYAQALADVASGNSTLDATAADIEKISELFSDSTVSDFFADPTLDVEKKRQLVDDIAESSAFQPHTRNFLYILVDAQRIDLINEIAKEFELVYNKLTDTELAVVTSVVKLESQHLAQIAKQVQKLTGAKNVRIKTLLDPSLVAGFTVRYGNSGSKLIDMSVRKQLEDIAAQLELSDITLAV

SEQ ID NO: 10142 - protein, 640 aa, Glycine max
MEVHQVVPPPHKSTLQKLQGRLKETFFPDDPLRQFKGQPLKRKLILGAQYVFPILQWGPKYNLKLFKSDLVSGLTIASLAIPQGISYAKLASLPPIVGLYSSFVPPLVYAVLGSSKDLAVGPVSIASLVMGSMLRQEVSPTADPILFLQLAFTSTLFAGLFQASLGILRLGFIIDFLSKAILIGFMAGAAIIVSLQQLKSLLGITHFTNQMGLIPVMTSVFHNIHEWSWQTILMGICFLVLLLLARHVSIKKPKLFWVSAGAPLMSVIISTLLVFAIKAQNHGISAIGKLQQGINPPSWNMLLFHGSHLGLVMKTGLITGILSLTEGIAVGRTFAALKNYKVDGNKEMMAIGFMNVVGSFTSCYVTTGAFSRSAVNNNAGAKTAVSNVVMSVTVMVTLLFLMPLFQYTPNVVLGAIIVTAVIGLIDLPAACNIWKIDKFDFVVMLTAFLGVLFISVQGGLALAVGLSTFKILLQITRPKTVMLGKIPGTDIYRNLDQYKEAVRIPGFLILSIEAPINFANITYLNERTLRWIEEEEEDNIKEQLSLRFLVLEMSAVSAVDTSGISLFKELKATLEKKGLVLVNPLAEVIEKLKKADEANDFIRADNLFLTVGEAVASLSSAMKGQSSTITEGTHTIVSHN

SEQ ID NO: 10143 - protein, 641 aa, Cajanus cajan
MEVHQVVPPPHKSTLQKLKARLKETFFPDDPLRQFKGQPLKRKLILGAQYVFPILQWGPKYNLKLFKSDLVSGLTIASLAIPQGISYAKLASLPPIVGLYSSFVPPLVYAVLGSSKDLAVGPVSIASLVLGSMLRQEVSPTAEPVLFLQLAFTSTLFAGLFQASLGILRLGFIIDFLSKAILIGFMAGAAIIVSLQQLKSLLGITHFSNQMGLVPVMSSVFHNIHEWSWQTILMGICFLMLLLLARHVSIRKPKLFWVSAGAPLASVIISTLLVFAIKAQNHGISVIGKLQQGINPPSWNMLLLHGSHLGLVMKTGIITGILSLTEGIAVGRTFAALRNYKVDGNKEMMAIGFMNVVGSFTSCYVTTGAFSRSAVNNNAGAKTAVSNVVMSVTVMVTLLFLMPLFQYTPNVVLGAIIVTAVIGLIDVPAACNIWRIDKFDFLVMLVAFLGVLFISVQGGLALAVGLSTFKILLQITRPKTVMLGKIPGTDIYRNLHQYKEAVRIPGFLILSIEAPINFANITYLNERTLRWIEEEEDSIKEQPSLRFLILEMSAVSAIDTSGISLFKELKTTLENKGVELVLVNPLSEVIEKLKKADEANDFIRVDNLFLTVGEAVASLSSAMKGQSSTITEGLHTIVSCN

SEQ ID NO: 10144 - protein, 651 aa, Vigna unguiculata
PNEVQHSHCLEMTMELHQVVPPPHKTTLTKLKTRLKETFFPDDPLRQFKGQPLKTKLILAAQYLFPILQWGPKYTFKLFKSDLVAGLTIASLAIPQGISYAKLANLPPIVGLYSSFVPPLVYAVLGSSRDLAVGPVSIASLVLGSMLRQEVSPTADPVLFLQLAFTSTFFAGLFQASLGILRLGFIIDFLSKAILIGFMAGAAIIVSLQQLKSLLGTSHFTNQMGLIPVMTSVFHNIHEWSWQTILMGICFLVLLLLARHVSIKKPKLFWVSAGAPLLCVIISTLVVFAIKAQNHGISVIGKLQQGINPPSWNMLRFHGSHLGLVMKTGLITGILSLTEGIAVGRTFAALKNYKVDGNKEMMAIGFMNVVGSSTSCYVTTGAFSRSAVNNNAGAKTAVSNVVMSVTVMVTLLFLMPLFQYTPNVVLGAIIVTAVIGLIDLPAAYNIWKIDKFDFLVMLTAFMGVLFISVQGGLALAVGLSTFKILMQITRPKTVMLGKIPGTDIYRNLHQYKEAVRVPGFLILSIEAPINFANITYLNERTLRWVEEEEDNIKEQSSLRFLILEMSAVSAIDTSGISLFKELKATLEKKGVELVLVNPLAEVIEKLKKVDEASDFMQADNLFLTVGEAVASLSPTMKGQSPTFLGGAHTIV

SEQ ID NO: 10145 - protein, 638 aa, Vigna unguiculata
MELHQVVPPPHKTTLTKLKTRLKETFFPDDPLRQFKGQPLKTKLILAAQYLFPILQWGPKYTFKLFKSDLVAGLTIASLAIPQGISYAKLANLPPIVGLYSSFVPPLVYAVLGSSRDLAVGPVSIASLVLGSMLRQEVSPTADPVLFLQLAFTSTFFAGLFQASLGILRLGFIIDFLSKAILIGFMAGAAIIVSLQQLKSLLGTSHFTNQMGLIPVMTSVFHNIHEWSWQTILMGICFLVLLLLARHVSIKKPKLFWVSAGAPLLCVIISTLVVFAIKAQNHGISVIGKLQQGINPPSWNMLRFHGSHLGLVMKTGLITGILSLTEGIAVGRTFAALKNYKVDGNKEMMAIGFMNVVGSSTSCYVTTGAFSRSAVNNNAGAKTAVSNVVMSVTVMVTLLFLMPLFQYTPNVVLGAIIVTAVIGLIDLPAAYNIWKIDKFDFLVMLTAFMGVLFISVQGGLALAVGLSTFKILMQITRPKTVMLGKIPGTDIYRNLHQYKEAVRVPGFLILSIEAPINFANITYLNERTLRWVEEEEDNIKEQSSLRFLILEMSAVSAIDTSGISLFKELKATLEKKGVELVLVNPLAEVIEKLKKVDEASDFMQADNLFLTVGEAVASLSPTMKGQSPTFLGGAHTIV

SEQ ID NO: 10146 - protein, 632 aa, Phaseolus coccineus
MEVHQVVPPPHKTTLHKLKARLKETFFPDDPLRQFKGQPLKTKLTLGAQYFFPILQWGPKYSLKLFKSDLVSGLTIASLAIPQGISYAKLANLPPIVGLYSSFVPPLVYAVLGSSRDLAVGPVSIASLVMGSMLRQEVSPTADPVLFLQLAFSSTFFAGLFQASLGILRLGFIIDFLSKAILIGFMAGAAIIVSLQQLKSLLGITDFTNQMGLIPVMTSVFHSIHEWSWQTILTGICFLVLLLLARHVSIKRPKLFWVSAGAPLFCVIISTLLVFAIKAQNHGISVIGKLQQGINPPSWNMLCFHGTHLGLVMKTGLITGILSLTEGIAVGRTFAALKNYKVDGNKEMMAIGFMNMVGSSTSCYVTTGAFSRSAVNNNAGAKTAVSNVVMSVTVMVTLLFLMPLFQYTPNVVLGAIIVTAVIGLIDLPAAYNIWKIDKFDFLVMLSAFMGVLFISVQGGLALAVGLSTFKILMQITRPKTVMLGKIPGTEIYRNLHQYKEAVRVPGFLILSIEAPINFANITYLNERTLRWIEEEEDNIKEQFSLRFLILEMSAVSAIDTSGISLFKELKATLEKKSVELVLVNPLAEVIEKLKKVDEATDFIQADSLFLTVGEAIASLSSTMKAQSSTFHG

SEQ ID NO: 10147 - protein, 632 aa, Quercus alba
MEAHKVVTPPPMSTLQKLKIRLKETFFPDDPLRQFKGQPTKKKLILGAQYIFPILQWGPNYSLKLFKSDIVAGLTIASLAIPQGISYAKLANLPPIVGLYSSFVPPLVYAVLGSSRDLAVGPVSIASLILGSMLRQEVSPSNDPLLFLQLAFSSTFFAGLFQASLGLLRLGFIIDFLSKATLIGFMAGAAIIVSLQQLKSLLGITNFTKQMGLVPVLSSVFHNRKEWSWQTIVMGFCFLVLLLLARHVSMKRPKLFWVSAGAPLVSVIVSTLLVFASKANNHGISVIGKLQEGLNPPSWHMLHFHGSHLGLVMKTGLVTGILSLTEGIAVGRTFAALKDYQVDGNKEMIAIGLMNVVGSSTSCYVTTGAFSRSAVNHNAGAKTAASNIVMSVTVMVTLLLLMPLFQYTPNVVLGAIIVSAVVGLIDIPAAYQIWKVDKFDFIVLLCAFLGVIFISVQDGLAFAVGLSIFKILLQITRPKIVMLGNIPGTHIYRNLHHYKEAVRVPGFLILSIEAPINFANITYLNERILRWIEEFEAEEDSKKQSSLQFVILEMSAVSAIDTSGVSLFKALRKAMEKKGVELVLVNPLGEVMEKLLKADEAQDFMRPDSLYLTVGEAIASLSSTMKDQSSTM

SEQ ID NO: 10148 - protein, 194 aa, Solanum phureja
MAAKLPLPSCPTISKHFSADQTGSRFNGAVCLRRAAHSLGRIMHFQLSFTNIIQPYSFRNFKRRSWSIRSAADGSGLDSSPTTSGSSGTRLIRAIEALLVKLDARIKVLRKNLPMKLLFFLVGFYCATAFATVIGQTGDWDIISSGLAVAVVEGIGALMYRSIPLIDGVRGIIIMFNYWKTGLTLGLFLDSFKY

SEQ ID NO: 10149 - protein, 194 aa, Capsicum annuum
MAAKLPLPSCPTISKHLTADHTRSRFSGAVCLWRAAHSLGRILHFQLSFTNIVQPYSFRNFKRRAWSIRSAADGSGLDSNPSTSGSGGTRLIRAIEALLAKLDARIKVLRKNLPMKLLFFLVGFYCATAFATVIGQTGDWDIISAGLAVAVVEGVGALMYRSIPLIDGVRSLIIMFNYWKTGLTLGLFLDSFKY

SEQ ID NO: 10150 - protein, 80 aa, Capsicum annuum
MKLLFFLVGFYCATAFATVIGQTGDWDIISAGLAVAVVEGVGALMYRSIPLIDGVRSLIIMFNYWKTGLTLGLFLDSFKY

SEQ ID NO: 10151 - protein, 193 aa, Nicotiana benthamiana
MATKLPFPCFRTTSKHLVADNTRSRLSGTVCLRRAAHSLGSIMHFQLSFLNIVQRSSFRNFKRLVCIRSAADGSGLNSSPTTSSSGGTRLIRAIEALLVKLDARIKVLRKNLPVKLLFFLVGFYCATAFATVIGQTGDWDIISAGLAVAVVEGIGALMYRAIPLLDEVRSFITMINYWKTGLTLGLFLDSFKY

SEQ ID NO: 10152 - protein, 569 aa, Solanum phureja
MVSVATVDAQKAEVLSSVISPNQNQSSEELHVFRSKLPDISISNNIPLHVYLFERLSEFEERTCLIAGNSGETFTFGETHLICQKIAAGLTKVGIKKGDVIMTFLQNCSEFVFTFLASSMIGAVITTANPFYTKSEAFKQLKASNAKLIVTQSQYVDKFRDPAENDPKIGEDFSVVTIDDPPENCLHFSVLSEAKAEDMPKGVVIHPDDPVALPFSSGTTGLPKGVILTHKSLITGVAQLVDGDNPNFYLKHDDVVLCVLPLFHIFALNSVLLVSLRAGASVLLMQKFEISALLELIQKHRVSVAAVVPPLVLALAKNPMVDSFDLSSIRLVMSGAAPLGKELEEALHRRVPQAIFGQGYGMTEAGPVVTMCPAFAKQPLSTKSGSCGSVVRNADLKVVDPENGGSLDRNQPGEICIRGSQIMKGYLNDDEATARTIDVDGWLHTGDIGYVDDDDEIYIVDRVKELIKFKGFQVPPAELESLLISHPEIADAAVVPQKDGAAGEVPVAFVVRSAQGFDLTEEAIKEFIAKQVVFYKKLHKVYFIHAIPKSPSGKILRKDLRAKLAATPQ

SEQ ID NO: 10153 - protein, 570 aa, Capsicum annuum
MASVATVEAQKAEISSTVIPPSNQNQSSEELHVFRSRLPDIVISNDIPLHVYLFEKLSEFQERTCLIAGNTGQTFTFGETHFICQKIAAGLTNIGIKKGDVIMTFLQNCTEFVFTFLAASMIGSVITTANPFYTKSEAFKQLKASNAKLIVTQSQYVDKFRDPVENDPKINEDFLVVTIDDPPENCLHFSVLAEANADDMPKGVVIQPEDPVALPFSSGTTGLPKGVILTHKSLITGVAQLVDGDNPNLYLKHQDVVLCVLPLFHIFALNSVLLVSLRAGASVLLMQKFEIGTLLELIQKYRVSVAAVVPPLVLALAKNPMVDSFDLSSIRLVLSGAAPLGKELEEALHRRVPQAIFGQGYGMTEAGPVVTMCLSFAKQPLSTKSGSCGSVVRNADLKVVDPETGGSLDRNQPGEICIRGSQIMKGYLNDDEATARTIDVDGWLHTGDIGYVDDDDEIYIVDRVKELIKFKGFQVPPAELESLLVSHPDIADAAVVPQKDDAAGEVPVAFVVRSAQGFELTEEAIKEFIAKQVVFYKKLHKVYFIHAIPKSPSGKILRKELRAKLAATHS

SEQ ID NO: 10154 - protein, 135 aa, Petunia hybrida
MLSVEAQKAELSSPIPPSNQPSEELHVFRSRLPDIPINNTIPLHVYLFEKLSECQDRTCLIIGSSGKTYTFGETHLLCQKVAAGLTNIGIKKGDVIMTFLQNCAEFVCTFIAASMIGAVTTTANPFYQKQRCLSN

SEQ ID NO: 10155 - protein, 234 aa, Secale cereale
MGLGVRAAPFTYVAHALAVVAAAMVLYWCIHFRGGLAFEAANKNLIFNVHPVLMLIGFIILGSEAIMVYKVLPTVNHDTTKLIHLVLHAIALVLGAVGIYCAFKNHNETGVANLYSLHSWLGIGTISLYGIQWIFGFLAFFFPKAAPNVRKGALPWHILLGIFVYILALATAELGFLEKLTFLQSSGLDKYGPESFLVNFTALVVVLFGASVVVAAVAPARLEEPQGYAPIPEN

SEQ ID NO: 10156 - protein, 234 aa, Brachypodium distachyon
MGLGVRAAPFTYVAHALAVAAAAMVVVWCVHFRGGLAFEASNKNLIFNVHPVLMLIGYIILGSEAIMVYKVLPTWNHDTTKLIHLILHGIALVLGVVGIYCAFKFHNESGIANLYSLHSWLGIGTICLYGIQWVFGFLAFFFPGAAPNVRRGALPWHILFGMFVYILALATAELGFLEKLTFLQSSGLDKYGAEAFLVNFTALVVVLFGASVVVAAVAPARLEEPQGYAPIPEN

SEQ ID NO: 10157 - protein, 234 aa, Oryza sativa
MGLGVRAAPFTYVAHALAVAAATMVLVWCIHFRGGLAFEATNKNLIFNVHPVLMLIGYIILGSEAIMVYKVLPTWKHDTTKLIHLILHAIALVFGAVGIYCAFKFHNESGIANLYSLHSWLGIGTICLYGIQWIFGFVAFFFPRASPSVRKGVLPWHILFGLFVYILALATAELGFLEKLTFLQSSGLDKYGAEAFLVNFTALIVVLFGASVVVAAVSPARVEEPHEYAPIPES

SEQ ID NO: 10158 - protein, 234 aa, Panicum virgatum
MGLGVRAAPFTYVAHALAVAAAVMVLVWAIHFRGGLAIEATNKNLIFNVHPVLMLIGYIIIGSEAIMVYKVFPTLKHDTAKLVHLILHGIALVLGAVGIYFAFKNHNESGIANLYSLHSWLGIGTITLYGIQWIFGFVTFFFPGAAPNLRRSLLPWHILFGLFVYILALANAELGFLEKLTFLESSGLDKYGTEAFLVNFTALVVVLFGASVVVAAVAPARLEEPQGYAPIPEN

SEQ ID NO: 10159 - protein, 234 aa, Setaria italica
MALGVRAAPFTYVAHVLAVAAAAMVLVWAIHFRGGLAIEATNKNLIFNVHPVLMLIGYIIIGSEAIMVYKAFPTLNHDTAKLIHLILHGIALVLGAVGIYFAFKNHNESGIANLYSLHSWIGIGTIILYGIQWIFGFVTFFFPGAAPNLRKSVLPWHILFGLFVYILALANASLGFLEKLTFLESGGLDKYGTEAFLVNFTALVVVLFGASVVVAAIAPARLEEPQGYAPIPES

SEQ ID NO: 10160 - protein, 234 aa, Sorghum bicolor
MGLGVKATPFTYAAHALAAAAAVLVLVWCVHFRGGLALEAQNKNLIFNVHPVLMLIGYIILGSEAIMIYKVFPKLNHDTAKLTHLILHAIATVLGAFGIYCAFKYHNDSGIANLYSLHSWLGIGTISLYAIQWVFGFVTFFFPGAAPSVRRSALPWHALFGLFVYVLALATAELGFLEKLTFLESGGLDKYGAEAFLVNFTALVVVLFGASVVVAAVTPAHVEEPRGYAPIPIN

SEQ ID NO: 10161 - protein, 234 aa, Saccharum officinarum
MGLGVKATPFTYAAHALAAAAAVLVLVWCVHFRGGLALEAQNKNLIFNVHPVLMLIGYIILGSEAIMIYKVFPKLNHDTAKLTHLILHAIATVLGAFGIYCAFKYHNDSGIANLYSLHSWLGIGTISLYAIQWVFGFVTFFFPGAAPSVRRSALPWHALFGLFVYVLALATAELGFLEKLTFLESGGLDKYGAEAFLVNFTALVVVLFGASVVVAAVTPAHVEEPRGYAPIPVS

SEQ ID NO: 10162 - protein, 237 aa, Panicum virgatum
MAAAWLGVKAAPFTYAAHALAAVAAVLVLVWCVHFRGGLALEAQNKNLVFNVHPVLMLIGYIILGSEAIMIYKVFPKLNHDTAKLTHLILHAIATVLGAFGIYCAFKYHNDSGIANLYSLHSWLGIGTISLYGIQWVFGFVTFFFPGAAPSVRRSALPWHALLGLFVYVLALVTAELGFLEKLTFLESGGVDKYGAEAFLVNFTALVVVLFGASVVVAAVTPAHVEAPQGYESIPVN

SEQ ID NO: 10163 - protein, 237 aa, Setaria italica
MARAGLGVKATPFTYAAHALAAVAAVLVLVWCVHFRGGLALEAPNKNLIFNVHPVLMLIGYIILGSEAIMIYKVFPNLNHDTAKLTHLILHAIATVLGAFGIYCAFKFHNDSGIANLYSLHSWLGIGTISLYGIQWVFGFVTFFFPGAAPSLRRSALPWHALFGLFVYVLAVMTAELGFLEKLTFLESGGLDKYGAEAFLVNFTALVVVLFGASVVVAAVAPAHVEEPQGYAPIPVN

SEQ ID NO: 10164 - protein, 237 aa, Panicum virgatum
MAAAGLGVKAAPFTYAAHALAAAAAALVLVWCVHFRGGLALEAQNKNLIFNVHPVLMLIGYIILGSEAIMIYKVFPKLNHDTAKLTHLILHAIATVLGAFGIYCAFKFHNDSGIANLYSLHSWLGIGTISLYGIQWVFGFVTFFFPSAALSVRRSALPWHALFGLFVYVLALATAELGFLEKLTFLETGGLDKYGAEAFLVNFTALVVVLFGASVVIAAVTPAHVEAPQGYESIPVN

SEQ ID NO: 10165 - protein, 238 aa, Pennisetum glaucum
MAGAAGLGVKATPFTYAAHALAVTAAVLVLVWCVHFRGGLALEAPNKNLIFNVHPVLMLIGYIILGSEAIMIYKVFPNLNHDTAKLTHLILHAIATVLGAFGIYFAFKFHNDSGIANLYSLHSWLGIGTISLYGIQWVFGFVTFFFPGAAPSLRRSALPWHALFGLFVYVLALVTAELGFLEKLTFLESGGLDKYGAEAFLVNFTALVVVLFGASVVVAAVAPAHVEEPQGYAPIPVN

SEQ ID NO: 10166 - protein, 242 aa, Leymus cinereus x Leymus triticoides
MDDRDTTADLQEWELLLASPTAAAPGPYAGGGETVEDDAAGAIKYDYFELGSDAKYARRASLSAGAEEDKEEVTDEEAGDASWVEPHPGALAFPARDRAALWSDSSSDGERREDSEATEPLVETPRAATAAGADEGAVAKGGAAAAARWWKLPVEVLRLWVARAARSAWSVPVAVALLGVAVLGRRLYRMRRQSKAVARVRLVLDDKKASQFKAQPMLRRAPMIKPMLPANGVTPWPVLGHL

SEQ ID NO: 10167 - protein, 241 aa, Hordeum vulgare
MDARDATADLQEWELLLASPTAAAPGPYAVAGEPVEDDAAGAIKHDYFDLGSDAKYARRASLSIGAEEEGKEEGTDEEAGESSWVEPHPGALAFPARDRAALWSDSSSDGERREDAEATEPLVETPLEAPAAGADEGAVAKGGAVARWWRLPVEVLRLWAARAARSAWSVPVAVALLGIAVLGRRLHRMRRQSKAVARVRLVLDDKKASQFKAQPMLWRAPMIKPMLPGNGVTPWPVLGHL

SEQ ID NO: 10168 - protein, 234 aa, Avena sativa
MDREAAADLQEWELLLASPTAGAAVPYAVSGEVEDDAGAIKYDYFELGSDAKYTRRASLSMEEEEEVTDEEAGNAGWVEPHPDALAFPARDRAALWSDSSSDGERREEAEPTPAEPLVEPPQELAAADEGAVAKGGPPAPWWKLPMEVLRLWAARAARSAWSVPVAVALLGIAVLGRRLYRMRRQSKAVARVRLVLDDKKTSQFKAQRMLRRAPMIKPLLPPNGVTPWPVLGHL

SEQ ID NO: 10169 - protein, 991 aa, Hordeum vulgare
MATQSAVRLIGGGGAGGWTKDFGAFDSPLGNLPGEGLGFVESGSGIYGGWGESVPNRSGSAPPSMEGSLAALGNLIGQKSGNFDASLGNLDNVIGSSTAEEQLRADPAYFDYYGSKVNLNPRLPPPLISRESRRFMNRVGKVKEWRVVSQDDSNKGSLFIPRSTLSTHKEEPEDDKSPRLDSSSADDEQMNLVDFVPESFQQNPGSLYDNSSSHPSSSSIGDGVAVHSNIDSSRNLPHDVVKPSGLNSWTPVPLASGLISTHSSNLSSTYAPSSSCSDNNPSVQISEQQQEKQSIGTEPGIDMPISEVVVTELDVVDSSMKNLKLSLDSQTTPQVKQQWQGNFLQQYDFSPLVQGDHMPMTPHGAHLPHVPFVDNLPHTQLKLPTGDMPQLLPQLGMPTPFYTPNSFGSPYYQNLHPASVLATPYVTGGYALGGSGFPPVMTSYSPQSSAATPLDSPMTPSFSGRPSGFHSAGNFTAGTELVQPYKMYGQLGVPMQPPIPDPNFFQFFQHPSFPQYASGNQYNTLAPRGSVFGNVTDNFDPHKLFPQAQYPSDQRLQLPKTGISNSPTTLRGGTVPNYHGISPYVGAPLTYPTSPVFQGQPFSGISPSGRNDPARFQPASRNMTAVSGFQGQREREKFDSPKACTFLEELKSNRARRVELSDITGRIVDFSADQHGSRFIQQKLENCTAEEKAAVFAEVLPHASSLMTDVFGNYVIQKFFEHGTPEQRRDLAAKLAGHVVPLSLQMYGCRVIQKALEVMELDQKIDLVRELDGNIMRCVRDQNGNHVIQKCIECVPTEHIGFVVSAFRGQVASLSMHPYGCRVIQRVLEHCGGDSRGQCIIDEILQSACILAQDQYGNYVTQHVVEKGKSHERAQIISKLAGQVVTMSQNKFASNVIEKCFQHGDIAERDLLIREIVEQTDGNDTLLAMMKDQYANYVVQKILETCNDEQRELLVSRVKGHLQALRKYTYGKHIASRVEQLCGEGDAECDS

SEQ ID NO: 10170 - protein, 535 aa, Secale cereale
MATQSAVRLIGGGGAGGWTKDFGAFDSPLGNLPGEGLGFVENGSGIYGGWGESVPNRSGSAPPSMEGSLAALGNLIGQRSGNFDASLGNLDNVTGSSTAEEQLRADPAYFDYYGSKVNLNPRLPPPLISRESRRFMNRVGKVKEWRVVSQDDSNKGSLFIPRSTLSTHKEEPEDDKSPRLDSSSADDEQMNLVDFVPESFQQNPDSLYSSSHLSSSSIGDGVAVHPNIDSSRNLSHDVVKPSGLNSWTPVPLASVLRSTLSNNLSSTSVPSSSCSDNNPSIQLSEQQQEKQSIDMKPGNDVPVSGAVVTELDVVDSSMKNLKLSLDSQTTPQVKQQWQGNFLQQYGFSPLVQGEHMPMTPHGAHLPHVPFVDNVSHTQLKLPTGDMQQLLPQLGMPTPFYAPNSFGSPYYQNLHPASVLANPYVTAGYALGGSGFPPVMTSYSPQSSATTPLDSPMTPSFSGRPSGFPSAGNLTAGTEFVQPYKMYGQLGVPMQPPIPDPNFFQFFQHPSFPQYASGNQYNTLAPRGSVFWKCRR

SEQ ID NO: 10171 - protein, 938 aa, Triticum aestivum
SVPNRSGSAPPSMEGSLAALGNLIGQRSGNFDTSLGNLDNVTGSSTAEEQLRADPAYFDYYGSKVNLNPRLPPPLISRESRRFMNRVGKVKEWRVVSQDDSNKGSLFMPRSTLSTHKEEPEDDRSPRLDSSSADDEQMNLVDFVPESFQQNPDSLYDNSSHLSSSSIGDGVAVHSNIDSSRNLPHDVVKPSGLNSWTPVPLASVLRSTLSNNLSSTSVPSSSCSDNNPSVQISEQQQEKQSIDMKPGNDVPVSGAVVTELDVVDSSMKNLKLSLDSPTTSQVKQQWQGNFLQQYGFSPLVQGDHMAMTPHGAHLPHVPFVDNMSHTQLKLPTGDMQQLLPQLGMPTPFYTPNSFGSPYYQNLHPASVLANPYVTSGYALGGSSFPPVMTSYSPQSSAATPLDSPMTPSFSGRPSGFPSAGNLTVGTEFVQPYKMYGQLGVPMQPPIPDPNFFQFFQHPSFPQYASGNQYNTLAPRGSVFGNVADNFDPRKLFPQAQYPSDQRLQLPKTGIFNSPTTLRGGTVPNYHGISPYVGAPLTYPTSPVFQGQPFSGISPSGRNDSARFQSASRSMTAVSGFQGQREREKFDNPKACTFLEELKSNRARRVELSDITGRIVDFSADQHGSRFIQQKLENCTAEEKAAVFAEVLPHASSLMTDVFGNYVIQKFFEHGTPEQRRDLAAKLAGHVVPLSLQMYGCRVIQKALEVMELDQKIDLVRELDGNIMRCVRDQNGNHVIQKCIECVPTEHIGFVVSAFRGQVASLSMHPYGCRVIQRVLEHCGGDSRGQCIIDEILQSACILAQDQYGNYVTQHVVEKGKSHERAQIISKLAGQVVTMSQNKFASNVIEKCFQHGDIAERDLLIREIVEQTDGNDTLLAMMKDQYANYVVQKILETCNDEQRELLVSRVKGHLQALRKYTYGKHTASRVEQLCGEGDAECDS

SEQ ID NO: 10172 - protein, 983 aa, Brachypodium distachyon
MATQSAVRLIGGTGASSRSKDFGAYDSSLGMGNISGEGLGFVDNGSGVYGGWRESGPNRSGSAPPSMEGSLAALGNLIGQQSGNFDASLANIDNVTDSSKSEEQLRADPAYFDYYGSKVNLNPRLPPPLISRESRRFMNRVGKVKEWRVVSQDDSNKGSLFIPRSTLPTHREEPEEDRSPRLDSNSTDDAQMNLADFVPESFQQNISSLYDNSSSQPSSSNIGDAVAVHSNKNSPKNFSHDVKPSGLNSWTPVPVASGLRSTISNSLSPTSATNSSCSDNNTGRQTSPQEKRGIDMKPVNNAPGSGAVVTELDTLDSNMKNLKLSLDSHTPIASHVKQQWQDNLLLQYGSAPLIQGDHIQMTPNGTHLPHGPFVDNLSQTHLKLSNADMQQFLPQPGMTAPFYAPNSFGSPYYPNLHPASLLPGPFGTAGYALGGSALPPVMTSYSPQGSVATPLDSPITPTFSGRPSGFPSAGTEFVQPYKMYGQLGVAMQPPIPDPNFFHFFQHPSFPQYAGGNQFNTLGPRGSVFGNVADNFDPQKISPQAQYPSDQRVQLPRTGIPNSPTARRGATFPNYHSFPPYVGAPLTYPTSPVFPGISPSGSRNDSVRFQSPSRNMTASSGIQGQRDREKFDGPKACSFLEELKSNRARRVELSDITSRIVEYSADQHGSRFIQQKLENCTAEEKAAVFAEVLPHATSLMTDVFGNYVIQKFFEHGTPEQRRDLGTKLVGHVLPLSLQMYGCRVVQKALEVLELDQKIELVLELDGNIMRCVRDQNGNHVIQKCIECVPTEHIGFVVSSFQGQVASLSMHPYGCRVIQRVLEHCGGDSQGQCIIDEILQSACVLAQDQYGNYVTQHVLEKGKSHERAQIISKLAGQVVTMSQNKFASNVIEKCFQHGDFAERDLLIREIVQQTEGNDTLLAMMKDQYANYVVQKILETCNDQQRELLVSRVKGHLQALRKYTYGKHIASRVEQLCGEGGAESDS

SEQ ID NO: 10173 - protein, 187 aa, Secale cereale
EAAAATGLRPFAAPLGAATRAGAGWRCAPGQRRLGRGARVVARLDGGVGKGVPTTNYVVPLDKATGMTRPLVEILRDLNKRVPDKIIDPDTNTVPWYHANRMLSFYAPGWCGEVRDVIYSNSGTVTVVYRVILKGTDGEAFRDATGTAKVHEGRNDDAVAAAEEAAFSKACARFGFGLYLYHQDEIP

SEQ ID NO: 10174 - protein, 185 aa, Secale cereale
MEAAAAMGLRPFAATRAGAGAGWRCAPGQRRLWRGARVVARLDGGVGKGVPTTNYVVPLDKATGMTRPLVEILRDLNKRVPDKIIDPDTNTVPWYHANRMLSFYAPGWCGEVRDVIYSNSGTVTVVYRVILKGTDGEAFRDATGTAKVHEGRNDDAVAAAEEAAFSKACARFGFGLYLYHQDEIP

SEQ ID NO: 10175 - protein, 206 aa, Secale cereale
PLARSTKHAPRIPPPQSQPHAWRPRRLWGSAPSPRRSGAARRAGWRCAPGQRLGRGARVVARLDGGVGKGVPTTNYVVPLDKATGMTRPLVEILRDLNKRVPDKIIDPDTNTVPWYHANRMLSFYAPGWCGEVRDVIYSNSGTVTVVYRVILKGTDGEAFRDATGTAKVHEGRNDDAVAAAEEAAFSKACARFGFGLYLYHQDEIP

SEQ ID NO: 10176 - protein, 185 aa, Hordeum vulgare
MEAAALRPFAAPLGPARRAGVGWRCAPGQRRLGRGARVVARLDGGVGKGVPTTNYVVPLDKATGMTRPLVEILRDLNKRVPDKIIDPDTNTVPWYHANRMLSFYAPGWCGEVRDVIYSNSGTVTVVYRVILKGTDGEAFRDATGTAKVHQGRNDDAVAAAEEAAFSKACARFGFGLYLYHQDEIP

SEQ ID NO: 10177 - protein, 185 aa, Secale cereale
MEATGLRPFAAPLGAATRACAGWRCAPGQRRLARGARVVARLDGGVGKGVPTTNYVVPLDKATGMTRPLVEILRDLNKRVPDKIIDPDTNTVPWYHANRMLSFYAPGWCGEVRDVIYSNSGTVTVVYRVILKGTDGEAFRDATGTAKVHEGRNDDAVVAAEEAAFSKACARFGFGLYLYHQDEIP

SEQ ID NO: 10178 - protein, 193 aa, Brachypodium distachyon
MEAAAATTTTALLPSFSAPARTRSRTNNALPGWRAPPRRGRGLSMVARLDGGGMGRGVPTANYVVPLDKATGMTRPLVEILRDLNKRVPDKIIDPDTNTVPWYHANRMLSFYAPGWCGEVRDVIYSNNGTVTVVYRVILKGTDGEAFRDATGTAAVREGRSDDAVAAAEEAAFSKACARFGFGLYLYHQDEIP

SEQ ID NO: 10179 - protein, 145 aa, Unknown
  Sequence found in Organisms: Hordeum vulgare, Leymus cinereus x Leymus triticoides, Pseudoroegneria spicata, Triticum aestivum
MAFMRTSSNASSGMGVAPDIRETFLELQMKKAFRYVIFKIEEKQKQVVVEKTGATTESYDDFLACLPENDCRYALYDFDFVTGENVQKSKIFFIAWSPDTSRIRAKMLYSTSKDRIKQELDGFHYEIQATDPTEVELDVLRDRAH

SEQ ID NO: 10180 - protein, 145 aa, Triticum aestivum
MAFMRTSSNASSGMGVAPDIRETFLELQMKKAFRYVIFKIEEKQKQVVVEKTGATTESYDDFLACLPEKDCRYALYDFDFVTGENVQKSKIFFIAWSPDTSRIRAKMLYSTSKNRIKQELDGFHYEIQATDPTEVELDVLRDRAH

SEQ ID NO: 10181 - protein, 145 aa, Secale cereale
MAFMRTSSNASSGMGVAPDIRDTFLELQMKKAFRYVIFKIEEKQKQVVVEKTGATTESYDDFLACLPENDCRYALYDFDFVTGENVQKSKIFFIAWSPDTSRIRAKMLYSTSKDRIKQELDGFHYEIQATDPTEVELDVLRDRAH

SEQ ID NO: 10182 - protein, 145 aa, Brachypodium distachyon
MAFMRTSSNASSGMGVAPNIRETFLELQMKKAFRYVIFKIEEKQKQVIVEKTGATTESYDDFLASLPENDCRYALYDFDFVTGENVQKSKIFFIAWSPATSRIRAKMLYSTSKDRIKHELDGFHYEIQATDPTEVELQVLRDRAH

SEQ ID NO: 10183 - protein, 145 aa, Unknown
  Sequence found in Organisms: Festuca arundinacea, Avena sativa
MAFMRTSSNASSGMGVAPDIRQTFLELQMKKAFRYVIFKIEEKQKQVIVEKTGATTESYDDFLASLPENDCRYALYDFDFVTGENVQKSKIFFIAWSPATSRIRAKMLYSTSKDRIKHELDGFHYEIQATDPTEVEIDVLRERAH

SEQ ID NO: 10184 - protein, 145 aa, Oryza sativa
MAFMRSHSNASSGMGVAPDIRDTFLELQMKKAFRYVIFKIEEKQKQVVVEKTGATTESYDDFLASLPENDCRYALYDFDFVTGENVQKSKIFFIAWSPSTSRIRAKMLYSTSKDRIKQELDGFHYEIQATDPTEVDLEVLRERAH

SEQ ID NO: 10185 - protein, 145 aa, Cenchrus ciliaris
MAFMRSHSNASSGMGVAPNIRETFVELQMKKAFRYVIFKIEEKQKQVVVEKTGATTESYDDFLASLPENDCRYALYDFDFVTGENVQKSKIFFIAWSPSTSRIRAKMLYSTSKDRIKHELDGFHYEIQATDPTEVDIEVLRERAH

SEQ ID NO: 10186 - protein, 145 aa, Pennisetum glaucum
MAFMRSHSNASSGMGVAPNIRETFVELQMKKAFRYVIFKIEEKQKQVVVEKTGATTESYDDFLASLPENDCRYALYDFDFVTGENVQKSKIFFIAWSPATSRIRAKMLYSTSKDRIKHELDGFHYEIQATDPTEVDIEVLRERAH

SEQ ID NO: 10187 - protein, 145 aa, Zea mays
MAFMRSRSNASSGMGVAPNIRETFVELQMKKAFRYVIFKIEEKQKQVVVEKTGATTESYDDFLASLPENDCRYALYDFDFVTGENVQKSKIFFIAWSPSTSRIRAKMLYSTSKDRIKYELDGFHYEIQATDPSEVDIEVLRERAH

SEQ ID NO: 10188 - protein, 145 aa, Sorghum bicolor
MAFMRSHSNASSGMGVAPNIRETFVELQMKKAYRYVIFKIEEKQKQVVVEKTGATTESYDDFLASLPENDCRYALYDFDFVTGENVQKSKIFFIAWSPSTSRIRAKMLYSTSKDRIKHELDGFHYEIQATDPTEVDIEVLRERAH

SEQ ID NO: 10189 - protein, 145 aa, Unknown
  Sequence found in Organisms: Saccharum officinarum, Panicum virgatum
MAFMRSHSNASSGMGVAPNIRETFVELQMKKAFRYVIFKIEEKQKQVVVEKTGATTESYDDFLASLPENDCRYALYDFDFVTGENVQKSKIFFIAWSPSTSRIRAKMLYSTSKDRIKHELDGFHYEIQATDPSEVDIEVLRERAH

SEQ ID NO: 10190 - protein, 145 aa, Brachypodium distachyon
MCVRSLQSNASSGMGVAPNIRETFLELQMKKAFRYVIFKIEEKQKQVIVEKTGATTESYDDFLASLPENDCRYALYDFDFVTGENVQKSKIFFIARSPATSRIRAKMLYSTSKDRIKHELDGFHYEIQATDPTEVELQVLRDRAH

SEQ ID NO: 10191 - protein, 144 aa, Triticum aestivum
AFMRSHSNASSGMGVAPNIRETFVELQMKKAYRYVIFKIEEKQKQVVVEKTGATTESYDDFLASLPENDCRYALYDFDFVTGENVQKSKIFFIAWSPSTSRIRAKMLYSTSKDRIKHELDGFHYEIQATDPTEVDIEVLRERAH

SEQ ID NO: 10192 - protein, 145 aa, Setaria italica
MAFMRSHSNASSGMGVAPNIRETFVELQMKKAFRYVIFKIEEKQKQVVVEKTGATTESYDDFLASLPENDCRYALYDFDFVTGENVQKSKIFFIAWSPSTSRIRAKMLYATSKDRMKHELDGFHYEIQATDPTEMDIEVLRERAH

SEQ ID NO: 10193 - protein, 145 aa, Zea mays
MAFMRSRSNASSGMGVAPNIRETFVELQMKKTFRYVIFKIEEKQKQVVVEKTGATTESYDDFLASLPENDCRYALYDFDFVTGENVQKSKIFFIAWSPSTSRIRAKMLYSTSKDRIKYELDGFHYEIQATDPSEADIEVLRERAH

SEQ ID NO: 10194 - protein, 145 aa, Eragrostis curvula
  misc_feature (65)..(65): Xaa can be any naturally occurring amino acid
  misc_feature (80)..(80): Xaa can be any naturally occurring amino acid
  misc_feature (92)..(92): Xaa can be any naturally occurring amino acid
  misc_feature (97)..(97): Xaa can be any naturally occurring amino acid
  misc_feature (100)..(100): Xaa can be any naturally occurring amino acid
MAFMRTHSNASSGMGVAPNIRDTFHELQMKKAFRYVIFKIEEKQKQVVVEKTGATTESYDDFLAXLPENDCRYAIYDFDXVTGENVQKSKIXFIAWXPSXSRIRAKMLYSTSKDRIKQELDGFHYKIQATDPSEVDLEVLRERAH

SEQ ID NO: 10195 - protein, 140 aa, Zea mays
MQSNASSSMGVALKIRETFVELQMKKAFRYVIFKIEEKQKQVVVEKTGATTKNYDDFLASLLENDCRYALYDFDFVTRENVQKSKIFFIAWSPSTSRIRAKMLYSTSKDRIKYELDGFHYEIQATDPSEADIEVLRERAH

SEQ ID NO: 10196 - protein, 150 aa, Hordeum vulgare
MAFMRTCSNASCGMGVAPDIRETFLELHMNNAFPYVIFKIEEKDRLVVVEKTGATTESREDFLACLPENDCRYAHDDFDYDTGQNVQKSKMFFIDWSPDTSGIRANMLDYTYKDRIKQELNGFHYEIQATDPTEVELDMLRDRAHYGVSM

SEQ ID NO: 10197 - protein, 164 aa, Zea mays
ITLHNSMQSNASSGMGVAPNIRETFVELQMKKTFRYVIFKIEEKQKQVVVEKMGRLLKAMMIFWPLCRRMTADMRYMILILLLGRMCRKVRFSSLPGPQHRRHPTSVLRCCTRPRRTVSSMSSTGSTTRSRRPTHPRWTLRFCGSGLTEVGSPLKKKGPIYGGS

SEQ ID NO: 10198 - protein, 278 aa, Secale cereale
MALPLVRLLLPSLPACQPPLRHPEYSAPPRHSHVSFAVSAAARSSGHRLAFAVCAASASVAPTPAETEADAEDEQPVGPKTRLIAMNIPWDFTPDDIRVLFEKQGTVVDVELSMHSSKKNRGLAFVTMGSEEEALSALKNLNLSTLNDRTIKVDFAKPKKKQPIVPSAPVDKNVVFVGNLTWRVRSRHLRELFASTPGVESVEVIFHTTTPRRSAGYAFVSFSSKEEAEAAISTFNGKELMGRSINVMFKEDTPKKNRSSDSEEEKLEEAESSEESDS

SEQ ID NO: 10199 - protein, 278 aa, Hordeum vulgare
MALPLVRLLLPSLPACQPPLRHPEYSAPPRHSHISFAVPAAARSSGHRLAFSVCAASASVAPASVETEADAEDEEPVGPKTRLIAMNIPWDVTPDDIRVLFEKQGTVVDVELSMHSSKKNRGLAFVTMGSEEEALSALKNLNLSTLNDRTIKVDFAKPKKKQPAVPSAPVEKNVVFVGNLTWRVRSRHLRELFASTPGVQSVEVIFHTTTPRRSAGYGFVSFSSKEEAEAAISTFNGKELMGRSINVMFKEDTPKKNKSSDSEEGKLEEAESSEDSDS

SEQ ID NO: 10200 - protein, 250 aa, Pseudoroegneria spicata
  misc_feature (10)..(11): Xaa can be any naturally occurring amino acid
  misc_feature (182)..(182): Xaa can be any naturally occurring amino acid
PRHSHVSFAXXAAARSSGHRLAFAVCTASASVAPAPAETEADAEDEQPVGPKTRLIAMNIPWDFTPDDIRVLFEKQGTVVDVELSMHSSKKNRGLAFVTMGSEEEALSALKNLNLSILNDRTIKVDFAKPKKKQPIVPSAPVEKNVVFVGNLTWRVRSRHLRELFASTPGVQSVEVIFHTTXPRRSAGYAFVSFSSKEEAEAAISTFNGKELMGRSINVMFKEDTPKKNKFFDSEEEKLEEAESSEESDS

SEQ ID NO: 10201 - protein, 289 aa, Festuca arundinacea
  misc_feature (149)..(149): Xaa can be any naturally occurring amino acid
  misc_feature (157)..(157): Xaa can be any naturally occurring amino acid
  misc_feature (202)..(202): Xaa can be any naturally occurring amino acid
  misc_feature (212)..(212): Xaa can be any naturally occurring amino acid
ARGFSVLPASPTMALPLVRLLLPSLPACQPPLRLPEHSAPPRHGHVSLALSTAARCSVHRAAFAVCASSASVAPAPAPAETEAEDEQPTGPKTRLIAMNIPWDFTPDDMRALFEKQGTVVDVELSMYSSKKNRGLAFITMGSEEEAISXLNNLNLSXLNDRTIKVDFAKPKKKQPIVPSAPVEKNVVFVGNLMWRVRSRHLXELFASTPGVXSVEVIFHTTTPRRSAGYAFVSFSSKEEAEAAIATFNGQELMGRSINVMFKEDTTKKSKSSASEEEKLEVESSEESDS

SEQ ID NO: 10202 - protein, 255 aa, Avena sativa
HCAPPRHGHVSFALSTAPRSSGHRAAFAVCASSASVAPAPAPAETEAEAEDEQPTGPKTRLIAMNIPWDFTPDDMRALFEKQGTVVDVELSMYSSKKNRGLAFITMGSEEEALSALNNLNLSTLNDRTIKVDFAKPKKKQPSVPSAPVEKNVVFVGNLMWRVRSRHLRELFASTPGVQSVEVIFHTTTPRRSAGYAFVSFSSKEEAEAAIATFNGQELMGRSINVMFKEDNAKKNKSSASEEETLEVESSEDSDS

SEQ ID NO: 10203 - protein, 486 aa, Hordeum vulgare
MSCFSCFGPALEAEAGKPGPDAKDARGKDGAAPDRAGSDKLKLQGGSDPKNTHLTIPRDGNSQNIAAQIFTFRELAAATKNFRQDCMLGEGGFGRVYKGRLENGQAVAVKQLDRNGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPTQHTRSNSSTPRARNMGGRNSEQRNGRSPNHHSPRTSKHGGEVSRTSSNGGDSGRRSGLDDMDMAGSQAGSPAQTGRKRDTPRTADRHRAVVDAKMWGENSRERKRPNGHGSFDSTNE

SEQ ID NO: 10204 - protein, 484 aa, Hordeum vulgare
ASPASARPLRRRPASAGPDAKDARGKDGAAPDRAGSDKLKLQGGSDPKNTHLTIPRDGNSQNIAAQIFTFRELAAATKNFRQDCMLGEGGFGRVYKGRLENGQAVAVKQLDRNGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPTQHTRSNSSTPRARNMGGRNSEQRNGRSPNHHSPRTSKHGGEVSRTSSNGGDSGRRSGLDDMDMAGSQAGSPAQTGRKRDTPRTADRHRAVVDAKMWGENSRERKRPNGHGSFDSTNE

SEQ ID NO: 10205 - protein, 491 aa, Oryza sativa
MSCFLCFGSAQEGEAKKPGADSKDARKDGSADRGVSRVGSDKSRSHGGLDSKKDVVIQRDGNNQNIAAQTFTFRELAAATKNFRQDCLLGEGGFGRVYKGRLETGQAVAVKQLDRNGLQGNREFLVEVLMLSLLHHTNLVNLIGYCADGDQRLLVYEFMPLGSLEDHLHDLPPDKEPLDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPVQHSRSNSSTPRARNLAGWNEDRRSVRSPNHHSPDLRREAARSSRAEVSRTSSTGDSGRRSGLDDLDMTGSQMGSPAQTGRKRETPRTADRQRAIAEAKTWGENSRERKHPNGHGSFDSTNE

SEQ ID NO: 10206 - protein, 492 aa, Setaria italica
MSCFVCFGSAQDGEAKKQVADAKDPRKDGPPDRGVARVGSDKSRSQGGSDSKDIIIHRDGNSQNIAAQTFTFRELAAATKNFRQDCLLGEGGFGRVYKGRLENGQAVAVKQLDRNGLQGNREFLVEVLMLSLLHHTNLVNLIGYCADGDQRLLVYEFMPLGSLEDHLHDLPKDKEALDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNSKPQGEQNLVAWARPLFKDRRKFPKMADPKLQGRFPMRGLYQALAVAAMCLQEQAATRPHIGDVVTALSYLASQAYDPNAPVQHSRSNSSTPRARNPAGWNDDQRSVRSPNHHSPDLRRRDAARASKYGAEVSRTSSTGGSGRRSGLDEMDMTGSQMGSPAQTGRRRETPRAAADRQRAIAEAKMWGEYSRERSNGHGSFDSTNE

SEQ ID NO: 10207 - protein, 493 aa, Panicum virgatum
MSCFVCFESAHDGEADKPAAADAKDSRKDGPPDRGVVRVGSDKSRSQGGSDSKKDIIIHRDGNSQNIAAQTFTFRELAAATKNFRQDCLLGEGGFGRVYKGRLENGQAVAVKQLDRNGLQGNREFLVEVLMLSLLHHTNLVNLIGYCADGDQRLLVYEFMPLGSLEDHLHDLPPDKEALDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNTRPQGEQNLVAWARPLFKDRRKFPKMADPMLQGRFPMRGLYQALAVAAMCLQEQGTTRPHIGDVVTALSYLASQAYDPNAPVQHSRSNSSTPRARNPAGWNDDQRNMRSPNRHSPDLRRREAARASKYGAEVSRTSSTGDSGRRSGLDDLDMTGSQVGSPAQTGRRRETPRAADRQCAIAEAKMWGEYSRERSNGHGSFDSTNE

SEQ ID NO: 10208 - protein, 492 aa, Zea mays
MSCFVCFGSAAHDGESRKPPAAGAGKDVPPDRAVVRVGSDKSRSQGGPESKKDLIIHRDGNSQNIAAHTFTFRELAAATKNFRQDCLLGEGGFGRVYKGRLENGQAVAVKQLDRNGLQGNREFLVEVLMLSLLHHTNLVNLIGYCADGDQRLLVYEFMPLGSLEDHLHDLPPDKEPLDWNTRMKIAAGAAKGLEYLHDKTSPPVIYRDFKSSNILLGEGFHPKLSDFGLAKLGPVGDKTHVSTRVMGTYGYCAPEYAMTGQLTVKSDVYSFGVVFLELITGRKAIDNTKTQGEQNLVAWARPLFKDRRKFPKMADPMLQGRFPMRGLYQALAVAAMCLQEQAATRPHIGDVVTALSYLASQAYDPNAPVQHSRSNASTPRSRNPAAWNGDQRSVRSPNHHHSPDPRRRDPARASKYGAEVSRTSSASDSGRRSGLDDMDPTGSQVGSPAQTGRRREAPRATDRQRAVGEARMWGENSRERTNGHGSFDSTHE

SEQ ID NO: 10209 - protein, 491 aa, Brachypodium distachyon
MGCLPCFGSGGKGEAKKGRAGARKDVPPDRRGTLAGSDKSKPQGGLDSKKDAVIPREGNNQHIAAHTFTFRELAAATKNFRQDCLLGEGGFGRVYKGRLDNSQVVAVKQLDRNGLQGNREFLVEVLMLSLLHHDNLVNLIGYCADGDQRLLVYEYMPLGSLEDHLHDIPPEKEPLDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPHGEQNLVAWARPLFKDRRKFPKMADPSLQGRFPMRGLYQALAVAAMCLQEQAATRPFIGDVVTALSYLASQAYDPNAPTQHNRSNASTPRARDRGSGNSDQRRINSPNHHSPDVRRREATTTSKYEAEVSRNSSGGGSGRRSALDDGDATGSQVGSPAHAGRRREASRTSDRQRAIAEAKTWGENSRERKWPNARGSFDSTNE

SEQ ID NO: 10210 - protein, 490 aa, Triticum aestivum
MGCLPCFGSSGKGEPAKKGGARKDVPSDRRATGVGSDKPKPQGLLDSKKDTVIPREGNNQHIAAHTFTFRELAAATKNFRQDCLLGEGGFGRVYRGRLDNGQAVAVKQLDRNGLQGNREFLVEVLMLSLLHHDNLVNLIGYCADGDQRLLVYEYMPLGSLEDHLHDIPPEKEPLDWNTRMKIAAGAAKGLEYLHDKASPPVIYRDFKSSNILLGEEFHPKLSDFGLAKLGPVGDKTHVSTRVMGTYGYCAPEYAMTGQLTVKSDVYSFGVVFLELITGRKAIDNTKPHGEQNLVAWARPLFKDRRKFPKMADPALQGRFPMRGLYQALAVAAMCLQEQAATRPFIGDVVTALSYLASQAYDPNAPTQHSRSNASTPRARDRGSVNGDQRRIRSPNHHSPDLRRKEATTTSKYEAEVSRNSSGGGSGRRSGLDDRDVTGSQQGSPAQAGKRRETSRTSERQRAIAEAKTWGENSRERKWPNARGSFDSTNE

SEQ ID NO: 10211 - protein, 489 aa, Triticum aestivum
MGCLPCFGSSGKGEPAKKGGARKDVPSDRRATGVGSDKPKPQGLLDSKDAVIPREGNNQHIAAHTFTFRELAAATKNFRQDCLLGEGGFGRVYRGRLDNGQAVAVKQLDRNGLQGNREFLVEVLMLSLLHHDNLVNLIGYCADGDQRLLVYEYMPLGSLEDHLHDIPPEKEPLDWNTRMKIAAGAAKGLEYLHDKASPPVIYRDFKSSNILLGEEFHPKLSDFGLAKLGPVGDKTHVSTRVMGTYGYCAPEYAMTGQLTVKSDVYSFGVVFLELITGRKAIDNTKPHGEQNLVAWARPLFKDRRKFPKMADPALQGRFPMRGLYQALAVAAMCLQEQAATRPFIGDVVTALSYLASQAYDPNAPTQHSRSNASTPRARDRGSVNGDQRRIRSPNHHSPDLRRKEATTTSKYEAEVSRNSSGGGSGRRSGLDDRDVTGSQQGSPAQAGKRRETSRTSERQRAIAEAKTWGENSRERKWPNARGSFDSTNE

SEQ ID NO: 10212 - protein, 487 aa, Secale cereale
MALALSTLPFAPSTPASASFRPRGAHFAPSPAGRSVGVGLPLACAAPRKNRGRRRRGGGLVVFAAADYYATLGVPRSATIKDIKAAYRKLARQYHPDVNKEPGATDKFKEISSAYEVLSDDKKRALYDQYGEAGVKSAVGGNAGAYTSNPFDLFETFFGASMGGGGGGFSGMDQSAFRTRRRSTAAQGEDIRYDVILGFSEAIFGTEKDIILSHLETCDACSGSGSKVGSKAKICSTCGGRGQVMRTEQTPFGLFSQVSICPTCVGEGEVISEYCRKCSGEGRVRVRKEIKVKIPPGVSKGSTLRVRGEGDAGPKGGPPGDLFVCLDVEEPSDIKRDGINLYSTVSISYVEAILGTVEKVRTVEGTSELRIPPGTQPGDVLVLAKQGVPSLNRPSIRGDHLFTVKVSIPKRISGREKELLEELASLKNGGFARAPVKPKPVHKENGSRAAPEVSDQPDDGEVDWLKKLSDFAGSIVNGASKWLKDNL

SEQ ID NO: 10213 - protein, 454 aa, Secale cereale
RSVGVGLPLACAAPRKNRGRRRRGGGLVVFAAADYYATLGVPRSATIKDIKAAYRKLARQYHPDVNKEPGATDKFKEISSAYEVLSDDKKRALYDQYGEAGVKSAVGGNAGAYTSNPFDLFETFFGASMGGGGGGFSGMDQSAFRTRRRSTAAQGEDIRYDVILGFSEAIFGTEKDIILSHLETCDACSGSGSKVGSKAKICSTCGGRGQVMRTEQTPFGLFSQVSICPTCVGEGEVISEYCRKCSGEGRVRVRKEIKVKIPPGVSKGSTLRVRGEGDAGPKGGPPGDLFVCLDVEEPSDIKRDGINLYSTVSISYVEAILGTVEKVRTVEGTSELRIPPGTQPGDVLVLAKQGVPSLNRPSIRGDHLFTVKVSIPKRISGREKELLEELASLKNGGFARAPVKPKPVHKENGSRAAPEVSDQPDDGEVDWLKKLSDFAGSIVNGASKWLKDNL

SEQ ID NO: 10214 - protein, 486 aa, Brachypodium distachyon
MALAFSTVPFAPSNPAPSSRSAAAAALRPHGVHFAAAGRSGGLGIPLACAAPRNRRQRRGVRLVVWASADYYATLGVQRSANIKDIKAAYRKLARQYHPDVNKEPGATDKFKEISSAYEVLSDEKKRALYDQYGEAGVKSAVGGSAGAYTSNPFDLFETFFGANMGGFSGMDQNAFRTRRRSTTVQGEDIRYDVNLGFSEAIFGTEKDIILSHLETCDTCSGSGSKAGSKTRICSTCGGRGQVMRTEQTPFGLFSQVSICPTCAGEGEVISEYCRKCSGEGRVRVRKEIKVKIPPGVSKGSTLRVRGEGDAGPKGGPPGDLFVCLDIEEPSDIKRDGINLYSTVSISYIEAILGTVEKVRTVDGTSELRIPPGTQPGDVVVLAKQGVPSLNRPSIRGDHLFTIKVNIPKRVSGRERELLEELASLTNGGFARAPVKPKPIHQESGSSVAQEQSDQPAEGEGDWFQKLTDFAGSIASGAAKWLKDNL

SEQ ID NO: 10215 - protein, 487 aa, Oryza sativa
MAFATSTLPFAPSNPSPSSRSAAAAFSPRGGVHFAAARSGLPLACAAPRHRGRPPPRRRRGGCLVVWASADYYATLGVPRSASNKDIKAAYRKLARQYHPDVNKEPGATDKFKEISAAYEVLSDEKKRALYDQYGEAGVRSAVGGSAGAYTSNPFDLFETFFGASMGGFSGMDQGTFRTRRRSTAVQGEDIRYDVNLGFSEAIFGTEKDIILSHLETCDACAGSGSKIGSKMRICSTCGGRGQVMRTEQTPFGLFSQVSICPTCAGEGEVISEYCKKCAGEGRVRVRKEIKVKIPPGVSKGSTLRVRGEGDAGPKGGPPGDLFVCLDIEEPADIKRDGINLYSTVSVSYIEAILGTVKKVRTVDGNSELRIPPGTQPGDVVVLAKQGVPSLNKPSVRGDHLFTIKVTIPKRISGREKELLEELASLSNGGFAGAPVKPKSIRQENETTVAQENSDQPDEGEGDWLKKLQDFAGSIANGAAKWLKDNL

SEQ ID NO: 10216 - protein, 442 aa, Avena sativa
MALALSTPFAPSNPAPSSRGAAAAFPPRGVHFAAAGRTGGVGLPLTCAAPRNRGRRRRGGGLVVLAAADYYTTLGVQRSADIKAIKAAYRKLARQYHPDVNKDPGATDKFKEISSAYEVLSDDKKRALYDQYGEAGVKSAVGGSAGAYTTNPFDLFETFFGANMGGGGGFSGMDQSAFRTRRRSTATQGEDIRYDVTLGFSEAIFGTEKDIILSHLETCDTCSGSGSKVGSKTRICSTCGGRGQVMRTEQTPFGLFSQVSICPTCTGEGEVISEYCRKCSGEGRVRVRKEIKVKIPPGVSKGSTLRVRGEGDAGPKGGPPGDLFVCLDVEEPSDIKRDGINLYSTVSISYIEAILGTVEKVRTVDGTSELRIPPGTQPGDVVVLAKQGVPSLNRPSIRGDHLFTIKVSIPKRISGREKELLEELASLTNGGFPSCACEAKTY

SEQ ID NO: 10217 - protein, 495 aa, Setaria italica
MAFALSTLPFVPSNPSPSSRAPADAAFPPRRVHFSAAVRSGGGDLPLACAAPRHRGRAPRRRRGGRLLVWASADYYATLGVPRSATNKDIKAAYRKLARQYHPDVNKEPGATEKFKEISAAYEILSDEQKRALYDQYGEAGVKSAVGGSGGAYTTNPFDLFETFFGASMGGFSGMDQSTFRTRRRSTAVQGEDIRYDVILGFTEAIFGTEKDIILSHLETCDTCGGSGSRAGSKMRICSTCGGRGQVMRTEQTPFGLFSQVSICPACAGEGEVISEYCRKCSGEGRIRVRKEIKVKIPPGVSKGSTLRVRGEGDAGPKGGPPGDLYVCLDIEEPSDIKRDGINLYSTVSVSYIEAILGTTKKVRTVDGTSELRIPPGTQPGDVIVLAKQGVPSLNKPSIRGDHLFTVTVTIPKRISGREKELLEELASLSGGGFARTAAKPKPAKPKPVHEEKEVGTSQEDAGKSNEGEGGWLKKLTDFAGSIANGAAKWLNDNL

SEQ ID NO: 10218 - protein, 497 aa, Sorghum bicolor
MALTSMLPFAPSNTSLSYSSRASTAAAFAPRGAHFAAYGRSGGGGAQSLACAAPRRCGRAPRRRRGGGLVVWASADYYATLGVPRAASNKDIKAAYRKLARQYHPDVNKEPGATEKFKEISAAYEVLSDEKKRALYDQYGEAGVKSAVGGPGGAYTTNPFDLFETFFGASMGGFSGMDQSSFRTSRRNTAVQGEDIRYDVILGFTEAIFGTEKDIILSHLETCDTCGGSGSKAGSKMRICSTCGGRGQVMRTEQTPFGLFSQVSICPTCAGEGEVISEYCRKCSGEGRIRVRKEIKVKIPPGVSKGSTLRVRGEGDAGPKGGPPGDLFVCLDIEEPSDIRRDGINLYSTVSISYLEAILGTVKGVRTVDGTSDLRIPPGTQPGDVIVLAKQGVPSLNKPSIRGDHLFTVKVAIPKRISGRERELLEELASLSNGGFARTDAKPKPAQPKRVHQEKEVGASQEDTDKSKEAEGDWLKKLTDFAGSIVNGAAKWLNDNL

SEQ ID NO: 10219 - protein, 488 aa, Zea mays
MAPTSMLPFAPSNTSLPYSSRATTAAAFAPRGLHHAAAGRSGGGQRLACAAPRRRRGGGLVVRASADYYATLGVPRAASNRDIKAAYRKLARQYHPDVNKEPGATEKFKEISAAYEVLSDEKKRALYDQYGEAGVKSAVGGSGGAYTTNPFDLFETFFGASMGGFSGMDQSAFRTSRRSTAIQGEDIRYDVILGFTEAIFGTEKDIILSHLETCDTCGGSGSKAGSKMRICSTCGGRGQVMRTEQTPFGLFSQVSICPTCAGEGEVISEYCRKCSGEGRIRVRKEIKVKIPPGVSKGSTLRVRGEGDAGPKGGPPGDLFVCLDIEEPSDIKRDGINLYSTVSISYLEAILGTVMQVRTVDGTSDLRIPPGIQPGDVIVLAKQGVPSLNKPSIRGDHLFTVKVAIPKRISGRERELLEELASLSNGRFARTDTKPKPAQPKAIHQEKEVGAIQEDTSKSKEAEGDWLKKLTDFAGSIVNGAAKWLNDNL

SEQ ID NO: 10220 - protein, 496 aa, Panicum virgatum
  misc_feature (11)..(11): Xaa can be any naturally occurring amino acid
  misc_feature (34)..(35): Xaa can be any naturally occurring amino acid
  misc_feature (43)..(43): Xaa can be any naturally occurring amino acid
  misc_feature (48)..(48): Xaa can be any naturally occurring amino acid
  misc_feature (83)..(83): Xaa can be any naturally occurring amino acid
  misc_feature (133)..(133): Xaa can be any naturally occurring amino acid
  misc_feature (273)..(273): Xaa can be any naturally occurring amino acid
  misc_feature (323)..(323): Xaa can be any naturally occurring amino acid
  misc_feature (414)..(414): Xaa can be any naturally occurring amino acid
  misc_feature (454)..(454): Xaa can be any naturally occurring amino acid
  misc_feature (462)..(462): Xaa can be any naturally occurring amino acid
MALALSTLPLXPSNPSPSSGATPAAAAFPPRRVXXAAAGRSGXGVLPXACAAPRHRGRVPRRRRGGSLVVWASADYYATLGVXRSATNKDIKAAYRKLARQYHPDVNKEPGATEKFKEISAAYEVLSDEKKRXLYDQYGEAGVKSAVGGSGGAYTTNPFDLFETFFGASMGGFSGMDQSTFRTRRRGTAVQGEDIRYDVILGFTEAIFGTEKDIILSHLETCDTCGGSGSKAGSKLRICSTCGGRGQVMRTEQTPFGLFSQVSICPTCAGEGXVISEYCRKCSGEGRIRVRKEIKVKIPPGVSKGSTLRVRGEGDAGPKGGPXGDLYVCLDIEEPSDIKRDGINLYSTLSISYLEAILGTTKMVRTVDGTSELRIPPGTQPGDVIVLAKQGVPSLNKPSIRGDHLFTVTVTIPXRISGRERELLEELASLSDGGFARTAAKPKPAKPKHVHEGXEVGTSQEXTDKSNEGEDDWLKKLTDFAGSVVNGAAKWLKDNL

SEQ ID NO: 10221 - protein, 597 aa, Triticum aestivum
MSQPAAAAVAAQPQGQAPAGRQGGGLGQSLAGIVRMAVFWYFASKFFGPKRAPTEPGLLMSNLFQKGEPMDMWMYLSENDKFSDFGNEDALIWHETNIPYAVWTPTSTRTHTLTYYPTEALKHNGSLYAHVYFSRSGYPVDPTDPEYEQKSAFGRTHPIVAYLRKSKAGHKKSLLGDSDESEEKLPPKENKESEDKEEGPVEYISYWKPNVTINLVDDFTRYPQNNIPPNVAPYLNVDPTTNSYYPTVFFNEFWLLRDKLTALNETVKELTLNLEVSPISMTKWQLFLQIEQSFQVHRSYGSMLEGEADELKRVFLEGNPYLLGLTMIVSLFHSLFDFLAFKNDIQFWNKNKSMEGLSAKSVVLNFICQLIIFLYLLDNDTSWMILASSGVGVCIEFWKIGKAMHVEIDRSGKIPMLRFRDRESYAQNKTKEYDALAMKYLTYVLLVLMAGFAIYSLKYDKHKSWYSWILSSLTSCVYMFGFIMMCPQLFINYKLKSVAHMPWRQMTYKFLNTIIDDLFAFVIKMPWLHRLSVFRDDVIFLIYLYQRWVYPVDKKRVNEFGFGGEDEPAAPQTLEGAAAAQQIEAKAETSTEDKKTK

SEQ ID NO: 10222 - protein, 597 aa, Hordeum vulgare
MSQPAAAAVAAQPQGQATAGRQGGGLGQSLAGIVRMAVVWYFASKFFGPKRAPTEPGLLMSNLFQKGEPMDMWMYLSENDKFSDFGNEDALIWHETNIPYAVWAPTSTRTHTLTYYPTEALKHNGSLYAHVYFSRSGYPVDPTDPEYEQKSAFGRTHPIVAYLRKSKAGHKKSLLGDSDESEEKLPPKENKESDDKEEGPVEYIAYWKPNVTINLVDDFTRYPQNNIPPNVAPFLNVDPTTNSYYPTVFFNEFWLLRDKLTALNETVKELTLNLEVSPISMTKWQLFLQIEQSFQVHRSYGSMLEGEADELKRVFLEGNPYLLGLTMIVSLFHSLFDFLAFKNDIQFWNKNKSMEGLSAKSVVLNFICQLIIFLYLLDNDTSWMILASSGVGVCIEFWKIGKAMHVEIDRSGKIPMLRFRDRESYAQNKTKEYDALAMKYLTYVLLFLMAGFAIYSLKYEKHKSWYSWILSSLTSCVYMFGFIMMCPQLFINYKLKSVAHMPWRQMTYKFLNTIIDDLFAFVIKMPWLHRLSVFRDDVIFLIYLYQRWVYPVDKKRVNEFGFGGEDEPAAPQTVEGAAAAQQIEAKAETSTEDKKTK

SEQ ID NO: 10223 - protein, 566 aa, Secale cereale
GIVRMAVFWYFASKFFGPKRAPTEPGLLMSNLFQKGEPMDMWMYLSENDKFSDFGNEDALIWHETNIPYAVWAPTSTRTHTLTYYPTEALKHNGSLYAHVYFSRSGYPVDPTDPEYEEKSAFGRTHPIVAYLRKSKAGHKKSLLGDSDESEEKLPPKENKESEDKEEGPVEYISYWKPNVTINLVDDFTRYPQNNIPPNVAPYLNVDPTTNSYYPTVFFNEFWLLRDKLTALNETVKELTLNLEVSPISMTKWQLFLQIEQSFQVHRSYGSMLEGEADELKRVFLEGNPYLLGLTMIVSLFHSLFDFLAFKNDIQFWNKNKSMEGLSAKSVVLNFICQLIIFLYLLDNDTSWMILASSGVGVCIEFWKIGKAMHVEIDRSGKIPMLRFRDRESYAQNKTKEYDALAMKYLTYVLLVLMAGFAMYSLKYDKHKSWYSWILSSLTSCVYMFGFIMMCPQLFINYKLKSVAHMPWRQMTYKFLNTIIDDLFAFVIKMPWLHRLSVFRDDVIFLIYLYQRWVYPVDKKRVNEFGFGGEDEPAAPQTLEGATAAQQIEAEAETSTEDKKTK

SEQ ID NO: 10224 - protein, 597 aa, Brachypodium distachyon
MSQPAVAAVAAQPQGQAPAARGGLGQSLAGIVRMAVFWYFASKFFGPKRAPTEPGMLMSNLFQKGEPMDMWMYLSENDKFNDFSNEDALIWHEANIPYAVWGPTSTRTRSLTYHPSEALKHNGSLYAHVYFARSGYPVDPTDPEYEQKSAFGRTHPIVAFLRKSKAGTKKSLLGNSNESEEQPTPKENKDAEDKDEGPVEFIAYWKPNVTINLVDDFTRYPHNNIPPNVAPYLNVDPTTSSYYPTVFFNEFWLLRDKLIALNETVEDLTLNLEVGPISMTKWQLYLQIEQSFQVHRSYGSMLEGEADELKRVFLEGNPYLLGLTMIVSLFHSLFDFLAFKNDIQFWNKNKSMEGLSAKSVVLNFICQLVIFLYLLDNDTSWMILASSGIGVCIEFWKIGKAMHVEIDRSGRIPMLRFRDRESYAQNKTKEYDAIAMKYLTYVLLFLMVGFAIYSLKYDKHKSWYSWILSSLTSCVYMFGFIMMCPQLFINYKLQSVAHMPWRQMTYKFLNTIIDDLFAFVIKMPLLHRLSVFRDDIIFLIYLYQRWVYPVDKKRVNEFGFGGEDEPPTAQTLEGTDSAAAAAQQIEAETSTEDKKTK

SEQ ID NO: 10225 - protein, 604 aa, Saccharum officinarum
MSQPAATVAAAAQPQGRGPAGRQGGGGGLGQSIAGIVRMAVFWYFAAKFFGPKRPPADPGMLMSNLFQKGEPMDMWMYLSENEKFNDFANEDALIWHEANIPYAVWGPTSTRTRSLTYYPSEALKHNGSLYAHVYFARSGYPVDPTDPEYEQKSAFGRTHPVVAFLPKSKAGKKKSLLGDSEEPEEQAPPKENKEFEDKDEGPTEYISYWKPNVTINLVEDFTRYPNNNVPPNVAPYLNVDPATGDYYPTVFFNEFWLLRDKLIALNETVEELPLNLEVGPISMTKWQLFLQIEQSFQVHRSYGSMLEGEADELKRVFLEGNPYLLGLTMVVSLLHSLFDFLAFKNDIQFWNKNKSMEGLSAKSVVLNFVCQLVVFLYLLDNDTSWMILASSGIGVCIEFWKIGKAMHIEVDRSGKIPMLRFRDRESYAQNKTKEYDAIAMKYLTYVLFLLVIGFSIYSLKYEKHKSWYSWILSSMTSCVYMFGFIMMCPQLFINYKLKSVAHMPWRQMTYKFLNTIIDDLFAFVIKMPMLHRLSVFRDDVIFLIYLYQRWKYPVDKKRVNEFGFGGEDEPAAQEALEGSDSAAAAAQPTEDEAETSTEDKKTK

SEQ ID NO: 10226 - protein, 607 aa, Oryza sativa
MSQPAAVAAGAAAGQQPQGRAQAARQAGGGLGQTIAGIVRMAVFWYFAAKFFGPKRPPAEPGMLMSNLFQKGEPLDMWMYLSENEKFNDFSNEDALVWHEANIPYAVWGPTSTRTHTLTYYPSEAIKNNGSLYAHVYFARSGYPVDPTDPEYEQSSAFGRTHPVVAYLRKPKDGKKKSLLGDSSESNEQPPPKENKDSVDKDEGPVEYISYWKPNVTINLVDDFTRYPHNNVPPNVAPYLNVDPSSNNYYPTVFFNEFWLLRDKLIALNETVEELPLNLEVGPISMTKWQIFLQMEQSFQVHRSYGSMLEGEADELKRVFLEGNPYFLGLTMIVSLFHSLFDFLAFKNDIQFWNKNKSMEGLSAKSVVLNFVCQLIIFLYLLDNETSWMILGSSGIGVCIEFWKIGKAMHVEIDRSGKIPMLRFRDRESYAQNKTKEYDAIAMKYLTYVLLFLVFCFSIYSLKYEKHKSWYSWILSSLTSCVYMFGFIMMCPQLFINYKLKSVAHMPWRQMTYKFLNTIIDDLFAFVIKMPMLHRLSVFRDDVIFLIYLYQRWVYPVDKKRVNEYGFGGEDEPQAPQTLEGSDLAAASQQAGAEAEAETSTEDKKTK

SEQ ID NO: 10227 - protein, 601 aa, Zea mays
MSQPAATVAAAAQPQGRGPAGRQGGLGQSIAGIVRMAVFWYFASKFFGPKRPPADPGMLMSNLFQKGEPMDMWMYLSENEKFNDFANEDALIWHEANIPYAVWGPTSTRTRSLTYYPSEALKHNGSLYAHVYFARSGYPVDPTDPEYEQKSSFGRTHPVVAFLPKSKAGKKKSLLGDSEEPEEKAPRNKENKESEDKDEGPTEYISYWKPNVTINLVEDFTRYPNNNVPPIVAPYLNVDPVTGDYYPTVFFNEFWLLKDKLIALNETVEELPLNLEVGPISMTKWQLFLQIEQSFQVHRSYGSMLEGEADELKRVFLEGNPYLLGLTMVVSLLHSLFDFLAFKNDIQFWNKNKSMEGLSAKSVVLNFVCQLVVFLYLLDNDTSWMILASSGVGVCIEFWKIGKAMHIEVDRSGKIPMLRFRDRESYAQNKTKEYDAIAMKYLTYVLFLLVVGFSIYSLKYEKHKSWYSWILSSMTSCVYMFGFIMMCPQLFINYKLKSVAHMPWRQMTYKFLNTIIDDLFAFVIKMPMLHRLSVFRDDVIFLIYLYQRWKYPVDKKRVNEFGFGGEDEPAAQEAVEGSDSAAAPQLTEAGSETSTEDKKTK

SEQ ID NO: 10228 - protein, 603 aa, Panicum virgatum
MSQPAAAVAAAEQPQGRGPAGRQGGGLGQSIAGIVRMAVFWYFAAKFFGPKRPPAEPGMLMSNLFQKGEPMDMWMYLSENEKFNDFANEDALIWHEANIPYAVWGPTSTRTRSLTYYPSEALKHNGSLYAHVYFARSGYPVDPTDPEYEQKSAFGRTHSVVAFLPKSKAGKKKSLLGDSEQPEEQAPAKENKEPEGKDEGPAEYISYWKPNVTINLVDDFTRYPHNNVPPIVAPYLNVDPATGDYYPTVFFNEFWLLRDKLIALNETVEELPLNLEVGPISMTKWQLFLQIEQSFQVHRSYGSMLEGEADELKRVFLEGNPYLLGLTMVVSLLHSLFDFLAFKNDIQFWNKNKSMEGLSAKSVILNFVCQLIVFLYLLDNDTSWMILASSGIGVCIEFWKIGKAMHIEIDRSGKIPMLRFRDRDSYAQNKTKEYDALAMKYLTYVLFLLVIGFSIYSLKYEKHKSWYSWILSSMTSCVYMFGFIMMCPQLFINYKLQSVAHMPWRQMTYKFLNTIIDDLFAFVIKMPMLHRLSVFRDDVIFLIYLYQRWKYPVDKKRVNEFGFGGEDEPAARETLEGNDSSAAAQLTGAEAEAETSTEDKKTK

SEQ ID NO: 10229 - protein, 595 aa, Sorghum bicolor
MSQPAATVAAAAQPQGRGPAGRQGGGGGLGQNIAGIVRMAVFWYFAAKFFGPKRPPADPGMLMSNLFQKGEPMDMWMYLSENEKFNDFANEDALIWHESNIPYAVWGPTSTRTRSLTYYPSETLKHNGSLYAHVYFARSGYPVDPTDPEYEQKSAFGRTHPVVAFLPKSKAGKKKSLLGDSEELEEQAPPKENKEFEDKDEGPTEYISYWKPNVTINLVEDFTRYPNNNVPPNVAPYLNVDPATGDYYPTVFFNEFWLLRDKLIALNETVEELPLNLEVGPISMTKWQLFLQIEQSFQVHRSYGSMLEGEADELKRVFLEGNPYLLGLTMVVSLLHSLFDFLAFKNDIQFWNKNKSMEGLSAKSVVLNFVCQLVVFLYLLDNDTSWMILASSGIGVCIEFWKIGKAMHIEVDRSGKIPMLRFRDRESYAQNKTKEYDAIAMKYLTYVLFLLVIGFSIYSLKYEKHKSWYSWILSSMTSCVYMFGFIMMCPQLFINYKLKSVAHMPWRQMTYKFLNTIIDDLFAFVIKMPMLHRLSVFRDDVIFLIYLYQRWKYPVDKKRVNEFGFGGEDEPAAQGALEGSAAQPTEAEAEDKKTK

SEQ ID NO: 10230 - protein, 605 aa, Setaria italica
MSQPAAEVAAAAQPQGRGPAGRQGGGLGQSITGIVRMAVFWYFAAKFFGPKRPPAEPGMLMSNLFQKGEPMDMWMYLSENEKFNDFANEDALIWHEANMPYAVWGPTSTRTRSLTYYPSEALKRNGSLYAHVYFARSGYPVDPTDAEYEQKSAFGRTHPVVTFLPKSKAGKKKSLLGDSEKPEEEAPPKENKESEDKDEGPAEYISYWKPNVTINLVEDFTRYPHNNVPPIVAPYLNVDPATGNYYPTVFFNEFWLLRDKLIALNETVEELPLNLEVGPMSMTKWQLFLQIEQSFQVHRSYGSMLEGEADELKRVFLEGNPYLLGLTMVVSLLHSLFDFLAFKNDIQFWNKNKSMEGLSAKSVILNFVCQLIVFLYLLDNDTSWMILASSGIGVCIEFWKIGKAMHIEIDRSGKIPMLRFRDRESYAQNKTKEYDALAMKYLTYVLFLLVVGFSIYSLKYEKHKSWYSWILSSMTSCVYMFGFIMMCPQLFINYKLKSVAHMPWRQMTYKFLNTIIDDLFAFVIKMPMLHRLSVFRDDVIFLIYVYQRWKYPVDKKRVNEFGFGGEDEPAAQEALEGSDSSAAAQLTEAKTEAEAETSTEDKKTK

SEQ ID NO: 10231 - protein, 601 aa, Pennisetum glaucum
AAEVAAAAQPQGRGPAARQGGGGGLGQSIAGIVRMAVFWYFAAKFFGPKRPPAEPGMLMSNLFQKGEPMDMWMYLSENEKFNDFANEDALIWHEANMPYAVWGPTSTRTRSLTYYPSEALKHNGSLYAHVYFARSGYPVDPSDPEYEQKSAFARTHPVVTFLPKSKAGKKKSLLGDSEKPEEEAPPKENKESEDKDEGPAEYISYWKPNVTINLVEDFTRYPHNNVPAIVAPYLNVDSDTGNYYPTVFFNEFWLLRDKLIALNETVEELPLNLEVGPISMTKWQLYLQIEQSFQVHRSYGSMLEGETDELKRVFLEGNPYLLGLTMVVSLLHSLFDFLAFKNDIQFWNKNKSMEGLSAKSVILNFVCQLIVFLYLLDNDTSWMILASSGIGVCIEFWKIGKAMHIEIDRSGKIPMLRFRDRESYAQNKTKEYDALAMKYLTYVLFLLMIGFSIYSLKYEKHKSWYSWILSSMTSCVYMFGFIMMCPQLFINYKLQSVAHMPWRQMTYKFLNTIIDDLFAFVIKMPMLHRLSVFRDDVIFLIYLYQRWKYPVDKKRINEFGFGGEDEPAAQEALEGSGSAAAAQQMEAKAEAETSTEDKKTK

SEQ ID NO: 10232 - protein, 598 aa, Zea mays
MSQPTAAVAAEAQPQGRGLAGRQGGGGGLGQSISGIVRMAVFWYFAAKFFGPKRPPADPGILMSNLFQKGEPMDMWMYLSESDKFNDFANEDALIWHEANIPYAVWGPTSTRTRSLTYYPSEALKHNGSLYAHVYFARSGYPVDPTDPEYEQKSAFGRTHPVVAFLPKSKAGKKKSLLGDSEEPEEQAPPKENKELEDKDEGPTEYLSYWKPNVTVNLVEDFTRYPNNNVPAIVASYLNVDPATGDYYPTVFFNEFWLLRDKLIALNESVKELPLNLEVGPISMTKWQFFLQIEQSFQVHRSYGSMLEGEADELKRVFLEGNPYLLGLTMIVSLLHSLFDFLAFKNDIQFWNKNKSMEGLSAKSVVLNFVCQLIVFLYLLDNDTSWMILASSGIGVCIEFWKIGKAMHIEVDRSGKIPMLRFRDRESYAQNKTKEYDAIAMKYLTYVLFLLVIGFSIYSLKYEKHKSWYSWILSSMTSCVYMFGFIMMCPQLFINYKLKSVAHMPWRQMTYKFLNTIIDDLFAFVIKMPMLHRLSVFRDDVIFLIYVYQRWKYPVDKKRVNEFGFGGEEEPAAQETLEGSDPAAAAAAAEPTEDKKTK

SEQ ID NO: 10233 - protein, 431 aa, Hordeum vulgare
GPPGAGPLRPAHSSASSALSDASNSSSASSLSLKRARTPRKRLNQTYNEAAALLASMYPSVFPAGDRAPPSPRLLGLASALADDPSRADLLPPFPVLGNAACLLRDAAPMQSPTPRSPVLARACPSPAAVSSAFTEFRDSAPSPGTPDGAAGADGPGELDFEDDDDSFDADSFLLGGADEGAAAEGIDGIMGKLSMENGSDASTINRVLSSSGIDPYIRNLMVLGLGFRRSRSNIKQALKRQDDDSEWWMCPAIPLKDIMPVPPPSMAPPPPPVEKKKKKTKKKALKDIAAGPCITCLKEEIPDPAYGDDGIFGLKAPKTGLGLSLNTEEVLKAWYDRGSVFADGNIPDASSADWLAKLSDIELFLENGAAGAIREGSVQKLKHKQKQCTPLLSNKTRYQARKVHAESRPRVKASTRTHSRALGLPSSVVY

SEQ ID NO: 10234 - protein, 192 aa, Hordeum vulgare
MKHLLLPSPLPLLLHGPASKPLLLHVRHRHRHAPSAAPDGNSGDTSTAASEPPPTNTQPSRPPSTPPSTNSGTTSVKTRLRSRNQARRVQDPYLPPVEVKMMRGKGKANASAAPRREKEKRKKTWDEMSLGEKAYELYVGEKGALFWLNKFAYASIFIMAGAWILFRFVGPATGLYQLDAPPLAPTDVLRGS

SEQ ID NO: 10235 - protein, 181 aa, Leymus cinereus x Leymus triticoides
HGPASKPLLLHVRQRHRYGPSAAPDGNSGDTSTAASELPPTDTQPSPPPSAPPSANSSTTSVKTRLRSRNQARRVQEAYLPPVEVKIMRGKGKANASAAAQAPRREKERRKKKWDEMSLGEKAYELYVGEKGALFWLNKFAYASIFIMAGAWILFRFVGPATGLYQLDAPPLAPTDVLRGS

SEQ ID NO: 10236 - protein, 126 aa, Pseudoroegneria spicata
  misc_feature (78)..(78): Xaa can be any naturally occurring amino acid
MAMTVEVLAGLACMFSTSVLLQILACALYNNWWPMLAALMYIIVPMPCLFFGDGSTRFLSSGEGGAWMKAAKFLTGMXAMGSLAIPAILRHAGLIETGAMFIEFTSFFILVCTVLCFHRATLDEEW

SEQ ID NO: 10237 - protein, 126 aa, Avena sativa
MAMTVEVLAGLACMFSTSILLQILACALYNNWWPMLAALMYIIVPMPCLFFGDGSTRFLSSGEGGAWINAAKFLTGASAMGSLAIPAILRHAGLIETGAMFIEFTSFFILVCTVLCFHRATLDDEW

SEQ ID NO: 10238 - protein, 126 aa, Brachypodium distachyon
MAMTVEVLAGLACMFSTSILLQILACALYNNWWPMLAALMYILVPMPCLFFGDGSTRFLTTGEGGAWINAAKFLTGASAMGSLAIPAILRHAGLIETGAMFIEFTSFFILVCTVMCFHRATLDEDW

SEQ ID NO: 10239 - protein, 126 aa, Unknown
  Sequence found in Organisms: Sorghum bicolor, Saccharum officinarum
MAMTVEVLAGLAFMFSTSILLQILACALYNNWWPMLAALMYVLVPMPCLFFGGGSTHFLTSREGGGWMNAAKFLTGASAMGSLAIPAILRHAGLIETGAMFIEFTSFFILVCTVLCFHRATLDEDW

SEQ ID NO: 10240 - protein, 126 aa, Unknown
  Sequence found in Organisms: Pennisetum glaucum, Panicum virgatum
MAMTVEVLAGLAFMFSTSILLQILACALYNNWWPMLAALMYVLVPMPCLFFGGGSTHFLTSREGGGWINAAKFLTGASAMGSLAIPAILRHAGLIETGAMFIEFTSFFILVCTVLCFHRATLDEDW

SEQ ID NO: 10241 - protein, 126 aa, Cynodon dactylon
MAMTVEVLAGLAFMFSTSILLQILACALYNNWWPMLAALMYVLVPMPCLFFGGGSTQFLTSRDGGGWINAAKFLTGASAMGSLAIPAILRHAGLIETGAMFIEFTSFFILVCTVLCFHRATLDEDW

SEQ ID NO: 10242 - protein, 126 aa, Zea mays
MAMTVEVLAALAFMFSTSILLQILACALYNNWWPMLAALMYVLVPMPCLFFGGGSTHFLTSREGGGWINAAKFLTGASAMGSLAIPAILRHAGLIETGAMFIEFTSFFILVCTVLCFHRATLDEDW

SEQ ID NO: 10243 - protein, 126 aa, Panicum virgatum
MAMTVEVLAGLAFMFSTSILLQILACALYNNWWPMLAALMYVLIPMPCLFFGGGSTHFLTSREGGGWINAAKFLTGASAMGSLAIPAILRHAGLIETGAMFIEFTSFFILVCTVLCFHRATLDEDW

SEQ ID NO: 10244 - protein, 126 aa, Oryza sativa
MAMTVEVLAGLAFMFSTSILLQILACALYNNWWPMLAALMYVLVPMPCLFFGGGSTQFLTSRDGGGWFNAAKFLTGASAMGSIAIPAILRHAGLIETGAMFIEFTSFFILVCTVMCFHRATLDEDW

SEQ ID NO: 10245 - protein, 113 aa, Setaria italica
MFSTSILLQILACALYNNWWPMLAALMYVLVPMPCLFFGGGSTHFLTSREGGGWINAAKFLTGASAMGSLAIPAILRHAGLIETGAMFIEFTSFFILVCTVMCFHRATLDEDW

SEQ ID NO: 10246 - protein, 126 aa, Musa acuminata
MAMTVEVLAGLAFMFSASILLQILACALYNNWWPMLSALMYVLLPMPCLFFGDGSTRFLTSREGGGWINAAKFLTGASAVGSIAIPAILRHAHLIETGAMLIEFTSFFILVCTVLCFHRVSLDEDF

SEQ ID NO: 10247 - protein, 113 aa, Musa acuminata
MFSASILLQILACALYNNWWPMLSALMYVVLPMPCLFFGDGSTRFLTSREGGGWINAAKFLTGASAVGSIAIPAILRHAHLIETGAMLIEFTSFFILVCTVLCFHRVSLDEDF

SEQ ID NO: 10248 - protein, 126 aa, Allium cepa
MAMTVEVLAGLAFMFSSSILLQILACALYNNWWPMLSALMYVVVPMPCLFFGDGSTRFLTSNEGGGFMNAAKFLTGASAVGSIAIPIILRHAGLIETGAMLIEFTSFFILVVTVLCFHKVSLDEDF

SEQ ID NO: 10249 - protein, 126 aa, Sesamum indicum
MAMTIEVLAGLAFMFSASILLQILACAIYNNWWPMLSALMYVLVPMPCLFFGGGSTQFLTSRDGGGWMDAAKFLTGASAVGSVAIPIILRHAGLIGTGAMFIEFTSFFIFVCTVLCFHRASLDDEW

SEQ ID NO: 10250 - protein, 126 aa, Elaeis guineensis
MAMTVEVLAGLAFMFSASILLQILACALYNNWWPMLSALMYVLVPMPCLFFGGGSTSFLTSREGGGWINAAKFLTGASAVGSIAIPAILRHANMIETGAMFIEFVSFFILICTVLCFHRVSLDEDW

SEQ ID NO: 10251 - protein, 126 aa, Triticum aestivum
MAMTVEVLAGLACMFSPSVLFPILACALSPHWWPMLAPLMYILVPIPCLFFGAGSPRFLSSGEGGAWMKPPNFLTGISALGSLPLPAILRPPGLIETGAIFIEFPSFFILVCPVLCFPRATLDEEW

SEQ ID NO: 10252 - protein, 126 aa, Ocimum basilicum
MAMTIEVLAGLAFMFSSSILLQILACAIYNNWWPMLSALMYVLVPMPCLFFGGGSTQFLMSRDGGGWIDAAKFLTGASAVGSMAIPIILRHAGLIGSGAMFIEFTSFFIFVCTVLCFHRANLDDEW

SEQ ID NO: 10253 - protein, 126 aa, Solanum melongena
MAMTIEVLAGLAFMFSSSILLQILACALYNNWWPMLSALMYVVVPMPCMFFGGGSTQFLISRDGGGWMDAAKFLTGASAVGSIAIPIILRHADLIQTGAMFIEFVSFFIFVCTVLCFHRANLDDEW

SEQ ID NO: 10254 - protein, 126 aa, Plantago ovata
MAMTVEVLAGLAFMFSSSILLQILACAIYSNWWPMLSALMYVMVPMPCLFFGGGSTQFLISRDGGGWMDAAKFLTGASAVGSIAIPVILHHAGLIGTGAMLIEFTSFFIFICTVLCFHRATLDDEW

SEQ ID NO: 10255 - protein, 126 aa, Triphysaria pusilla
MAMTVEVLAGLAFMFSASILLQILACAIYSNWWPMLSALMYVLVPMPCLFFGGGSTQFLLSRDGGGWMDAAKFLTGASAVGSLAIPIILKHAGLIGTGAMLIEFTSFFIFVCTVLCFHHASLDDEW

SEQ ID NO: 10256 - protein, 126 aa, Vinca minor
MAMTIEVLAGLAFMFSASILLQILACAIYNNWWPMLSALMYVIVPMPCLFFGGGSTQFLISRDGGGWIDAAKFMTGASAVGSIAIPIILRHADLIGTGAMFIEFTSFFIFVCTVLCFHRASLDDEW

SEQ ID NO: 10257 - protein, 60 aa, Persea americana
MSMTIEVLAGLAFMFSASILLQILACALYNNWWPMLSALMYVLVPMPCLFFGGGSTQFLT

SEQ ID NO: 10258 - protein, 794 aa, Hordeum vulgare
MGPGAPSPEDAAGGEPEAWYGSIQYLVNISAVGAASCVLLFLLVKLRFDHRRIPGPSALAAKLLAVYHATAPQIALHCGADAAQFLLFERASFLVLAAVSAAAFSAALPLNLLAGDAAIADQFAATTISHIPRASPLLWLHLLLTAAVVAIAHLGISRMEDALRITRFRDGNGNPSDPNSSSVAVFTIMIQGIPRTLAADKTPLKDYFEHKYPGKVYRVIVPFDLCTLEYLADQWGKVRNKISWLEARMDARSLFDEFVQDESGHLEAHWLVRRCKELWAMAAQRFGFTDDERLRKLQTSKLVIGSRLSDYKEGRAPGAGIAFVVFKDVYTANKAVRDFRMERKKTPIGRFFPVMELQLERSRWKVERAPPASDIYWNHLGMNKTSLALRRIAVNTCLIVMLLFFSSPLSILSGMQNAARIINVEAMDNAKSWIVWLQGSSWFWTIIFQFLPNVLIFVSMYIIIPSVLSYFSKFEFHLTVSGEQRAALLKMVCFFLVNLILLRALVESSLESWILSMGRCYLDSADCKQIEHYLSPSFLSRSSLSSLAFLITCTFLGISFDLLAPIPWIKHILKKFRKNDMVQLVPEENEEYRSMNNDEETNGLISPLMSEREDSDILNGFEGHDLSMYPINRSFHMPKQKFDFAQYYAFDITIFALTMIYSLFAPLVVPVGAVYFGYRYLVDKYNFLFVYRVRGFPAGNDGKLMDRVLCIMQFCVIFFLAAMLLFFAVQGDSMKLQAICTLGLLVFYKLLPSGSDRFQASLLEGMQTVNSFVDGPTDYEVFSQPDLDWNLYQS

SEQ ID NO: 10259 - protein, 792 aa, Oryza sativa
MGPTAPPPDAGGGEPEAWYGSIQYLVNISAVGAASCVLLFLLVKLRFDHRRIPGPSALAAKLLAVYHATAPQIALHCGADAAQFLLFERASFLVLAAVAAAAVAAALPLNLLAGDAAIADQFAATTISHIPKSSPLLWLHLLLTAAVVAIAHLGISRMEDALRITRFRDGNGNPSDPNSSSVAVFTIMIQGIPKTLAADKTPLKDYFEHKYPGKVYRVIVPFDLCTLEYLAEEWGKVRNRISWLEARMDARNLFDEFAQGGRHSEEHWIVRRCKELWVMTAERFGFTDEEMLRRLQTKKLVLGSRLSDYKDGRAPGAGIAFVVFKDVYTANKAVRDFRMERKKTPIGRFFPVMELQLERSRWTVERAPPASDIYWNHLGLSKTSLGLRRIAVNTCLILMLLFFSSPLAIISGMQSAARIINVEAMDNAKSWLVWLQSSSWFWTIIFQFLPNVLIFVSMYIIIPSVLSYFSKFECHLTVSGEQRAALLKMVCFFLVNLILLRALVESSLESWILSMGRCYLDSVDCKQIEQYLSPSFLSRSSLSSLAFLITCTFLGISFDLLAPIPWIKHVMKKFRKNDMVQLVPEENEDYQLMHDGEETNNLRAPLMSEREDSGILNGIEEHDLSLYPINRSFHMPKQTFDFAQYYAFDITIFALTMIYSLFAPLTVPVGAVYFGYRYLVDKYNFLFIYRVRGFPAGNDGKLMDMVICIMQFCVIFFLVAMLLFFAVQGDPMKLQAICTLSLLVFYKLLPSRSDRFQPSLLEGMQTVNSFVDGPTDYEVFSQPDLDWSLYQS

SEQ ID NO: 10260 - protein, 795 aa, Sorghum bicolor
MGPAAQPPDAGGGGDPEAWYGSIQYLINISAVGAASCVLLFLLVKLRFDHRRIPGPSALAAKLLAVYHATAAQIALHCGADAAQFLLFERASFLILAAVAAAAVAAALPLNLLAGDATVVDQFAATTISHIPKSSPLLWLHLLLTAAVVAIAHLGISRMEDALRITRFRDGNGNPSDPNSSSVAVFTIMIQGIPKTLAADKTPLKDYFDHKYPGKVYRAIVPFDLCTLEYLVDQLGKVRNKISWLEARLGARDLFDDIVHNDEAVRSEEHWFVRRCKELWAMAGERLGFTDEERLRKLQTKKLVLASRLSDYKEGRAPGAGVAFVVFKDVYTANKAVRDFKMERKKTPIGRFFPVMELQLERSRWKVERAPPASDIYWNHLGLSKISSRLRRIAVNTCLILMLLFFSSPLAIISGMQNAARIINVEAMDHAKSWLARLEGSSWFWTIIFQFLPNVLIFVSMYIIIPSVLSYFSKFECHLTVSGEQRAALLKMVCFFLVNLILLRALVESSLESWILSMGRCYLDGPDCKQIERYLSPSFLSRSSLSSLAFLITCTFLGISFDLLAPIPWIKHIMKKFRKNDMIQLVPEENEDYLPMQNGEETNNLTAPLMPEREDSGLLDSIEGHDLSLYPLNRSFHMPKQKFDFAQYYAFDITIFALTMIYSLFAPLVVPVGATYFGYRYLVDKYNFLFVYRVRGFPAGNDGKLMDRVLCIMQFCVIFFLAAMLLFFAVQGDSMKLQAICTLGMLVFYKLLPSRSDRFQPSLLEGMQTVNSFVDGPTDYEVFSQPDLDWNLYQS

SEQ ID NO: 10261 - protein, 794 aa, Setaria italica
MVPAAAPPDAGGGGDPEAWYGSIQYLINISAVGAASCVLLFLLVKLRFDHRRIPGPSALAAKLLAVYHATAPQIALHCGADAAQFLLFERASFLILAAVAGAAVVAALPLNLLAGDAAIIDQFATTTISHIPKSSPLLWLHLLLTAAVVAIAHLGISRMEDALRITRFRDGNGNPSDPNSSSVAVFTIMIQGIPKTLAADRTPLKDYFEHKYPGKVYRVIVPFDLCTLEYLVQELGKVRNKISWLEAKLGARDLFDDFAHAEAAQSEEHRFVRRCKELWVMASERLGFTDEERLRKLQTKKLVLGSKLSDYKEGRAPGAGVAFVVFKDVYTANKAVRDFKLERKKTPIGRFFPVMELQLERSRWKVERAPPASDIYWNHLGLSKMSSRLRRIAVNTCLLLMLLFFSSPLAIISGMQSAARIINVEAMDHAKSWLAWLEGSSWFWTIIFQFLPNVLIFVSMYIIIPSVLSYFSKFECHLTVSGEQRAALLKMVCFFLVNLILLRALVESSLESWILSMGRCYLDGPDCKQIEHYLSPSFLSRSSLSSLAFLITCTFLGISFDLLAPIPWIKHIMKKFRKNDMVQLVPEENEDYLMMQNGEESNNLTAPLMPEREDSGLLDSIEGHDLSLYPLNRSFHMPKQKFDFAQYYAFDITIFALTMIYSLFAPLVVPVGAAYFGYRYLVDKYNFLFVYRVRGFPAGNDGKLMDRVLCIMQFCVIFFLAAMLLFFAVQGDSMKLQAICTLGMLVFYKLLPSRSDSFQPSLLEGMQTVNSFVDGPTDYEVFSQPDLDWNMYQS

SEQ ID NO: 10262 - protein, 698 aa, Triticum aestivum
AAVSAAAFAAALPLNLLAGDAAIADQFAATTISHIPRASPLLWLHLLLTAAVVAIAHLGISRMEDALRITRFRDGNGNPSDPNSSSVAVFTIMIQGIPRALAADKAPLKEYFEHKYPGKVYRVIVPFDLCTLEYLADEWGKVRNKISWLEAKMDARSLFDEFVQDESGQLEAHWLVRRCKELWAMAAQRFGFTDDERLRKLQTRKLVIGSRLSDYKEGRAPGAGIAFVVFKDVYTANKAVRDFRMERKKTPIGRFFPVMELQLERSRWRVERAPPASDIYWNHLGMNKTSLALRRIAVNTCLIVMLLFFSSPLSILSGMQNAARIINVEAMDNAKSWIVWLQGSSWFWTIIFQFLPNVLIFVSMYIIIPSVLSYFSKFEFHLTVSGEQRAALLKMVCFFLVNLILLRALVESSLESWILSMGRCYLDSADCKQIEHYLSPSFLSRSSLSSLAFLITCTFLGISFDLLAPIPWIKHILKKFRKNDMVQLVPEENEEYRSMNNDEETNGLISPLMSEREDSDILNGFEGHDLSMYPINRSFHMPKQKFDFAQYYAFDITIFALTMIYSLFAPLVVPVGAVYFGYRYLVDKYNFLFVYRVRGFPAGNDGKLMDRVLCIMQFCVIFFLAAMLLFFAVQGDSMKLQAICTLGLLVFYKLLPSGSDRFQPSLLEGMQTVNSFVDGPTDYEVFSQPDLDWNLYQS

SEQ ID NO: 10263 - protein, 989 aa, Brachypodium distachyon
MVPAASAPDAGGGGGEPEAWYGSIQYLINISAVGASSCVLLFLLVKLRFDHRRIPGPSALAAKLLAVYHATAPQIALHCGADAAQFLLFERASFLVLAAVSAAAVAAALPLNLFAGDAAIADQFAATTISHIPKSSPLLWLHLLLAAAVVAIAHLGISRMEDALRITRFRDGNGNPSDPNSSSVAVFTIMIQGIPRTLAADKTPLKDYFEHKYPGKVYRVVVPFDLCTLEYLADEWGKVRNKISWLEARMDARNLFDEFVQDGSGQAEAHWFVRRCKELRAMAAERFGFTDDERLRRLQTNKLVLGSRLSDYKEGRAPGAGIAFVVFKDVYTANKAVRDFRMERKKTPIGRFFPVMELQLERSRWKVERAPPASDIYWNHLGMSKASLALRRIAVNTCLVVMLLFFSSPLAILSGMQSAARIINVEAMDSAKSWIVWLQGSSWFWTIIFQFLPNVLIFVSMYIIIPSVLSYFSKFEFHLTVSGEQRAALLKMVCFFLVNLILLRALVESSLESWILSMGRCYLDGADCKQIEQYLSPSFLSRSSLSSLAFLITSTFLGISFDLLAPIPWIKHILKKFRKNDMVQLVPEENEDYQYIQNGEETNGLITPLMSEREDSDILNTIEGHDLLLYPINRSFHMPKQKFDFAQYYAFDITIFALTMIYSLFAPLVVPVGAVYFGYRYLVDKYNFLFVYRVRGFPAGNDGKLMDRVLCIMQFCVIFFLAAMLLFFAVQDLLYKDYNFDQKFSLSTTSNTGLGLTATGVKIDELFIGDIQTQHRSGRTTVDVKIDSDSIVSTTVTVNEVISGLNSKLSFRVPDQMSGKLDLQYLHDRFALNSTIGLTSAPLVELAATVGTNELAVGAEVGFDSTSASVTKYNSGISYNKHDISAALLLADKGETLKASYIHLFSPTSAVAVEATHRLKTKENYFTIGSSHALDSSTLLKTRFSNNGKAGLLCQHEWRPKSFVTLSAEYDPKLVSSPSRFGVAIALKP

SEQ ID NO: 10264 - protein, 144 aa, Setaria italica
MDQQPQSDADFLEPSVLLDETHYQEGYKNGYHDGLSSGKEEGRQVGLKMGFQVGEELGFYQGCLDVWASATRIDQNVFSARVRKNIEQLAALVSSYPLSDPENEQVQDVMEKIRLKFRVITATLGAKLEYEGRPASSKQDVEDL

SEQ ID NO: 10265 - protein, 144 aa, Pennisetum glaucum
MDKQPQSDADFLEPSVLLDETHYQEGYKNGYHDGLSSGKEEGRQVGLKMGFQVGEELGFYQGCLDVWASAIRIDQNAFSARVRKNIEQLAALVSSYPLSDPENEQVQDVMEKIRLKFRVITASLGARLEYEGRPASSKQDVEDL

SEQ ID NO: 10266 - protein, 144 aa, Brachypodium distachyon
MDQQPKDDVDFLEPSILLDETHYQEGYKNGYDDGLVSGKEEGRQVGLKMGFQVGEELGFYQGCLDVWMSVIRLEEGAFSARVRKNMEQLAVLLSKYPLSDPENEQVQDMMEKIRLKFRVITASLGAKMEYEGRPTSSKQDVEDL

SEQ ID NO: 10267 - protein, 144 aa, Setaria italica
MDQQPQSDADFLEPSVLLDETHYQEGYKNGYHDGLSSGKEEGRQVGLKMGFQVGEELGFYQGCLDVWASAARIDQNVFSARVRKNIEQLAALVSSYPLYDPENEQVQDVMEKIRLKFRVITATLGAKLEYEGRPASSKQDVEDL

SEQ ID NO: 10268 - protein, 144 aa, Saccharum officinarum
MDQEPKIEADFLDPTLLLDETHYQEGYKNGYNDGLASGKEEGRQVGLKTGFQVGEELGFIQGCLDVWTSAILIDQNAFSARVRKNIEQLAALVSSYPLSDPENEQIQDVMEKIRLKFRVITASLGVKLEYEGHPTSSKQDVEDL

SEQ ID NO: 10269 - protein, 144 aa, Zea mays
MDQQAKIDADFLEPTVLLDETHYQEGYKNGYNDGLASGKEEGRQVGLKMGFQVGEELGFFQGCLDVWTSAILIDQNAFTARVRKNIEQLAALVGSYPLSDPENEQIQDVMEKIRLKFRVITASLGVKLEYEGHPKSSKQDAEDL

SEQ ID NO: 10270 - protein, 144 aa, Zea mays
MDQQAKIDADFLEPTVLLDETHYQEGYRNGYNDGLASGKEEGRQVGLKMGFQVGEELGFFQGCLDVWTSAILIDQNAFTARVRKNIEQLAALVGSYPLSDPENEQIQDVMEKIRLKFRVITASLGVKLEYEGHPKSSKQDAEDL

SEQ ID NO: 10271 - protein, 144 aa, Zea mays
MDQQAMIDADFLEPTVLLDETHYQEGYRNGYNDGLASGKEEGRQVGLKMGFQVGEELGFFHGCLDVWTSAILIDQNAFTARVRKNIEQLAALVGSYPLSDPENEQIQDVMEKIRLKFRVITASLGVKLEYEGHPKSSKQDAEDL

SEQ ID NO: 10272 - protein, 144 aa, Zea mays
MDQQAKIDADFLEPTVLLDETHYQEGYINGYNDGLASGKEEGRQVGLKMGFQVGEELGFFQGCLDVWTSAILIDQNAFTARVRKNIEQLAALVGSYPLSDPENEQIQDVMEKIRLKFRVNTASLGAKLEYEGHPKSSKQDAEDL

SEQ ID NO: 10273 - protein, 51 aa, Zea mays
MDQQAMIDADFLEPTVLLDETHYQEGYRNGYNDGLASGKEEGRQVGLKMGF

SEQ ID NO: 10274 - protein, 137 aa, Zea mays
MLIFFEPTVLLDETHYQEGYRNGYNDGLASGNEEGRQVGLKMGFQVGEELGFFQGCLDVWTSAILIDQNAFTARVMKNIEQLAALVGSYPLSDPENEQIQDVMEKIRLKFRVITASLGVKLEYEGHPKSSKQDVEDL

SEQ ID NO: 10275 - protein, 96 aa, Panicum virgatum
  misc_feature (21)..(21): Xaa can be any naturally occurring amino acid
MGFQVGEELGFYQGCVDVWTXATRIDQNVFSTRVMKNIEQLAALVSSYPLSDPENEQVQDVMEKIRLKFRVITASLGVKLEYEGRPASSKQDVEDL

SEQ ID NO: 10276 - protein, 400 aa, Triticum aestivum
FVALLVLGVGGGDDTPVEQPKKLYISPPNAKRFQLPDGRHLAYEEKGISADRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMANPYDSKMTKDEKRKIWDRWSTKRKLMHILARRFPSLLRLFYHTSFLSGKQGQTESWLSLSMGKKDKTLLEAPMFNAFWEKDVAESVRQGDAQPFVEEAVLQVSDWGFSLSDIQMQKKEDQGVFEFIKSLFSQAEREWVGFLGPIHIWQGMDDRVVPPSATEFARRMVPGATVHKLLDEGHFSYFCFCDECHRQIFSTLFGTPQGPLNPALESSEVAPEPVEETSPAYDEEVAGQEQETSGVA

SEQ ID NO: 10277 - protein, 420 aa, Triticum aestivum
EYLAEDRDPVRCWVVVAAVAFVALLVLGVGGGDDTPVEQPKKLYISPPNAKRFQLPDGRHLAYEEKGISADRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMANPYDSKMTKDEKRKIWDRWSTKRKLMHILARRFPSLLRLFYHTSFLSGKQGQTESWLSLSMGKKDKTLLEAPMFNAFWEKDVAESVRQGDAQPFVEEAVLQVSDWGFSLSDIQMQKKEDQGVFEFIKSLFSQAEREWVGFLGPIHIWQGMDDRVVPPSATEFARRMVPGATVHKLLDEGHFSYFCFCDECHRQIFSTLFGTPQGPLNPALESSEVAPEPVEETSPAYDEEVAGQEQETSGVA

SEQ ID NO: 10278 - protein, 562 aa, Pennisetum glaucum
LLAVPAGPRRRNIRRRRRVPSGVGEANARVVPHERGQVLVPRHRRRRRHLAAAAPIALRFACTCSPVQERFGNWKGNEERRRAEEGWAQQARGFAESTAEMLLELGRGLWDVAAQSLAGAEDSELARRLRKRAAATGERLSFMNEYLPEERDPVRCWLIVAAVAFVTLLVLGVGSGNETPVELPKKLIISPPSASRIQLPDGRHLAYEEQGVSADRARFSLIAPHSFLSSRLAGIPGISASLLEEFGARLVTYDLPGFGESDPHPGRNLNSSALDMLHLANALDIPDKFWVVGYSGGGMHAWSALRYIPDRIAGAAMFAPMANPYDSKMTKDERHKTWDSWSTKRKLMHILARRFPSLLPLFYRRSFLSGKQGQADSWLSLSLGKKDKTLLDGPEFNAFWERNVAESVRQGDARPFVEEAVLQVSDWGFSLSDIQMQKKEDRGFFELIKSLFNQVEREWVGFLGPIHIWQGMDDRVVSPAVAEFVRRVVPGATVHRLLDEGHFSYFCFCDECHRQIFSTLFGIPQGPINPVPQPSEVASELAEETTAPDNVTEQEQGKSNLA

SEQ ID NO: 10279 - protein, 526 aa, Zea mays
MTWHEDLATHVGNTGVRLPGAGGHAPAAANVAAAGAGWYGEEEEGRAEEGWAQQAKGFAESTAEMLRELGRGLWDVAAQSLAGAEDSEVARRLRKRAAATGKRLSFMNEYLPEERDPVRCWLTVAAVAFVSLLVLGFGSGNETPVELPKKLIIGPPSADRIQLPDGRHLAYQEQGVSANRARFSLIYPHSFLSSRLAGIPGIRASLLEEFGVRLVTYDLPGFGESDPHIGRNLNSSAMDMLYLANALNIPEKFWVVGYSGGGMHAWSALRYIPDRIAGAAMFAPMANPYDSKMTKDERRKTWDSWSTKRKLMHILARRFPSLLPFFYRQTFLSGKQGHPESWLSLSLGKKDKTLLEGPAFNAFWERNVAESVRQGDARPFVEEAVLQVSDWGFSLSDIQMQKKEARGFFELIKSLFNQAEREWVGFLGPIHIWQGMDDRVISPSVAEFVRRLVPGATVHKLLDEGHFSYFCFCDECHRQIFSTLFGIPQGPMNPAPQPSEVVSELNEEITVPDNVTDQEQGKSGLP

SEQ ID NO: 10280 - protein, 615 aa, Triticum aestivum
EEWSSVLTAISRADEKPQLDVNFELFLRVYAEMQLRLKGGKKARERDGGQGIKRSSSSSAAFLTASTTTLLHTISESEKASYVGHINAYLAEDPFLKNALPVDPATDQLFHLTKDGVLLCKLINLAVPGTIDERAINTKRLLNLWEKNENHTLCLNSAKAIGCTVVNIGTQDLAEGRPHLILGLISQIIKIQLLADVNLKSTPQLVELVQDSQEMEELMSLSPEKILLRWMNFQLKKGGFQRTVTNFSSDIKDSEAYACLLNVLAPECSAKPSPMSVKDLLHRARLVLEHADRMGCKRYLAPKDIVDGLQNLNLAFVAHIFQKRNGLSKQMKQVSFVDGVSDDAQVSREERSFRLWINSLGISTYINNVFEDLRNGWVLLEVMDKVAPGSVNWKFANRPPIKLPFRKVENCNQVLKIGKEIKFSLVNIAGHDIVQGNKKLILAFLWQLMRYNILQLLKNLRFHSNGKEITDNDILLWANKKVKDSGRQSQMGSFKDRSLSSGIFFVNLLSAVEPRVVNWSLVTKGEKDEEKQMNASYIISVARKLGCSIFLLPEDIMEVNQKMMLTLTASIMYWHLKRPTSYSLDADNSSLCETSSISTSDDSASESSIDDSGTR

SEQ ID NO: 10281 - protein, 132 aa, Pennisetum glaucum
MDAKNTGNEHQAQQKPDAVTGSVPRPDQGTLKQFADLDAGNISPVASGQEADVNMEAAISTEDVMRAGGFGAKDDIGSLLPTAIDSTDFEASLRDARDFEGGNEAPSHPGLGWKGEKADDGSKPSHVPQQLP

SEQ ID NO: 10282 - protein, 132 aa, Panicum virgatum
MDGKNLGNEQQAQQKKRDAVTDNVPSLDQEALKQFSDSDAGNISPANGNEADVNMEAAISTEDVMRAGGFGAKDDIGSVLPTAIDSTDFEASLRDARDFEGEKEAPSHPGLGWKGEGGDDGSKPTDVPQQLP

SEQ ID NO: 10283 - protein, 137 aa, Panicum virgatum
MDGKNLGNEQQAQQKKPDAVTDNVPSIDQEALKQFSDSDAGNISPTNGHEADVNMEAAISTEDVMRAGGFGAKDDIGSLLPTAIDSTDFEASLRDARDFEGEKEAPSHPGLGWKGEKGDDGSKPSDVPQHGSSYRDI

SEQ ID NO: 10284 - protein, 678 aa, Saccharum officinarum
PWKQQERIVLPRKLPKGSKGAHAREQPAASVFSDIEKRLKDLDFQQSNKDLRALKQILDSMQAKGLLENKKREEASMPKLYDGNHDGQEIASVNMRLNSNTNNMWMPEESNAESSFKSPIVIMKPSKSANLFSEVDSSVLPLGGSSDPPQPQTSNSTDRRKASTINRTAKEQHAKFSQKVPTSQPLVSYDRRSYGRTDDCSNNQKSSSLLVTESSSRRQQLPRDSSISMQKNKNSTSPRLLQRKLDSERRARLPIPFAESNKIQRQSGDRNNSETVSPRSKFRRKLVRPQEGDDGMPNGLNNRTRSLNQHGNDMSTRSDGSISVASELDIISNDRSTEVNISNFEQGIGTPSGRNPQKVKTSYDASKDVPSVDPSAAIPERPSPVSVLDSSFDQEDLFPTSRTPNSLAVDDVHRTLEEPWKPSDTKPTEVAMQSKNNKLANVASLLEKLQQLSMNKDEDAPPVDHIAFLCETESPDHRYVSEILLASGLLMKDLGSGQAGLQLHSSGYPINPDLFHVLEQRKSGWVSIPDGIHQSRSGAKSDPKRAHRKLMFDTVNELLLQKFEKETAVYSVSSFTRAKDPPAKTPSGQQLLKFISSGIEDLDMERSSIWQKEGSVIPDAEILQRLQGWTSFSKELPGMVLEIERSIFKELVDEMVHGESADGPEMKVAGRRRRRLFA

SEQ ID NO: 10285 - protein, 706 aa, Pennisetum glaucum
GDLETFELIGSTGPETTGVRSMTFNPDGRSLLCGLHESLKVFSWEPIRCHDTVDVGWSRLADLNVHEGKLLGCSFNQSCVGIWVVDLTRLEPYATGTSSKLNGHSELKTVSSGTMPLQNDTGSKANIGRPSVLQNSENNLKASSGRLSVSQNSDSALKEAKSTASSGLVPSTPQRAGVGSNNRSFGNSAFASGGTTLKRSLLRSHNASSVSNFSKSDVVPVIVPRTSSGGELATDSRSDAADVAPVLSKANRRVDPATDSRKESTDAEPVIPKASSRMEISSDSTPSKSSRRLESGADSKKESADAAPAVVPRENTKMEMASDSAPVLSKASRKVDPGTDSKKESADATPVIPPRTSSRTEMASDSRREPSSGRISPFRIQSRYAELRKLTHAKVDANKAESRNKNTETDDFNCQIFLPRRNGVFHTISSEETREDIKHGAVDRMAFSNPAELNASVRSENYVSRVRKPRDNCYVEVSRAGRARSSVSNWEGRDQSPSHEEPTTSSSSLAPTGRSYSSRGSNQASETPTIASDEDVLSLLMEQHELFLSSTRSRLTKLQIIHQMWVRNDIRGVLSAMEKMCDHAVSADMASVLMEKSETITLDLCTSILPVAADLLESKTDRHLGVSLELLVKLVRTFGPMIHSTVSAGPFSVGVDLEAEQRRERCNLCFVELEKVKNKLPFLTRRKGAVANAAQELTLVFQEVMS

SEQ ID NO: 10286 - protein, 68 aa, Saccharum officinarum
MVHDDGVVDLFDLVLLSFDRVKKPSSDRCSSPSSSSFQLLISFFVTLRRPPWLWGIKRLGPKSVFFPS

SEQ ID NO: 10287 - protein, 80 aa, Sorghum bicolor
MCAAARPATSDEMCPSIIPHHVMRGEASSSASHPPPPTSKMQSCCPKLLGPSAAMIASPPPQESRLHLLPRGRGRRSYSP

SEQ ID NO: 10288 - protein, 293 aa, Panicum virgatum
SPEAGACAAHGVKCDVDVVSWRERRVLASVPVAADVDTLWQVITDYERLADFIPNLVQSVRIPCPHEGRIWLEQRGLQRALYWHIEARVVLDLQEVPDSINGRELHFSMVDGDFKKFEGKWSIRSGPRSSSAILLYEVNVIPRFNFPAIFLERIIRSDLPVNLRALASRAEKIYLENQRCGSRKISAMDSKTSSTSSQLKFHSTAIETTSSKFKEAPPTSGVSSVLPSPSSELISKWGVYGNACRIDRPCVVDEIHLRRFDGLLEHEGAHRCVFASITVKAPVRKVWNVSHGI

SEQ ID NO: 10289 - protein, 340 aa, Pennisetum glaucum
ILLYEVNVIPRFNFPAIFLERIIRSDLPINLRALACRAEKIYLENQQCGLRKFSTGDSKPSSTSSQLTAMETISSKFKEAPPTSGVSGVLPSPSSELISKWGVYGNACRIDRPCVVDEIHLRRFDGLLEQEGAHRCVFASITVKAPVREVWNVLTAYENLPEFVPNLAISRIVLRDNNKVRIMQEGCKGLLYMVLHARVVMDLREKLEEEIRFEQVEGDFYSFKGKWRFEQLGDQHTLLKYMVETKMHKDTFLSESILEEMIYEDLPSNLCAIRDYIEKAGPEGSNSTTHSGARTHPDIDPAENRQSEQESASCSFSSTKQRPKVPGLQKDIEILKCVHC

SEQ ID NO: 10290 - protein, 298 aa, Brachypodium distachyon
MSGGGGVLGAGSSYHRFVHSAMEQTRLRTALAPHPSQEKFKCIKANDDSTVFGALSFSAPKVRLLRSLTIEKENSVQVLDFAAFSEPEYDLPIFCANAFTSPVQSIVVLDLNPLYDITLYKDYKEKYFRNLMPLIQKYSELLPWGGKITSESLRFFSPVVIWSIFEPTEQNHHVLYSALMDYYKVWLELADQAIKENDASKIAHNREAQHRYLTWRAEKDPGYPLLKKLIGESHAKDLVTEFLFEGVNSLGSKSFLDYFPEYARDDGTVNKKRSMIGKSFETRPWDADGEFIGGDDAG

SEQ ID NO: 10291 - protein, 93 aa, Sorghum bicolor
MSSASYSTPDASTAYLPKPRSRFLATGAARLPSKVLAICSLSWPLLSGGLFSLLQPLLPLQGYQYSIAPLACFLACSVAGRELCCVRELGWMA

SEQ ID NO: 10292 - protein, 460 aa, Saccharum officinarum
MAATAAALRCCFPGSSAVGSGFVKPTSSRRGWCAAAVAAPSREAEPVSSLGHRTRVDFPILHQEFDGAKLVYFDNGATSQKPYSVMRTLDEYYRSYNSNVHRGIHALSAKATHAYEDARRKVANFVNAADSREIVFTRNATEAINLVAYSWGLSNVKEGDEIILTVAEHHSAIVPWQFVSQKTGATLKYVGLTKENVPDIEQLKGLLSNKTKIVVVHHVANVLGSMLPIEEIVTWSNRVGAKVLVDACQSVPHMPVDVQKLGADFLVASSHKMCGPTGVGFLHGKFEILSSMEPFLGGGEMIADVFQDKSTYAEPPSRFEAGTPAIGEAIGLGAAIDYLSCIGMEQIHEYEKELGTYLYQSLLSFPNVQIYGPAPSPTVHRAALCSFNVENVHPTDIAEILDLQHGVAIRSGHHCAQILHRTLGITASARASLHFYNTKDEVDTFIDALKATIDFLTTRY

SEQ ID NO: 10293 - protein, 460 aa, Zea mays
MAATAAALRCCFPGSSGVGSGFVKPNSSRRGWCAAAVAAPSREAEPVSSLGHRTRVDFPILHQEFDDAKLVYFDNGATSQKPCSVMKTLDEYYRSYNSNVHRGIHALSAKATHAYEDARRKVANFVNAADSREIVFTRNATEAINLVAYSWGLSNLKEGDEIVLTVAEHHSAIVPWQFVSQKTGATLKYVGLTKENVPDIEQLKGFLSNKTKIVVVHHVSNVLGSMLPIEEIVTWSNRVGAKVLVDACQSVPHMPVDVQKLGADFLVASSHKMCGPTGVGFLHGKFEILSSMEPFLGGGEMIADVFEDKSTYAEPPSRFEAGTPAIGEAIGLGAAIDYLSCIGMEQIHEYEKELGTYLYESLLSVPNVQIYGPAPSQTVHRAPLCSFNIENVHPTDIAEILDLQHSVAIRSGHHCAQILHRTLGINASARASLHFYNTKDEVDTFVDALKATVDFLTDRY

SEQ ID NO: 10294 - protein, 453 aa, Panicum virgatum
MAAAAALRCCFPGSAVGGGFIRPSSSRRGRHAAAVVAPPPASLGHRTRVDFPILHQEFDGAKLVYFDNGATSQKPYSVMKTLDEYYRSYNSNVHRGIHALSAKATDAYEGARRKVANFVNAADSREIVFTRNATEAINLVAYSWGLSNIKQGDEILLTVAEHHSAIVPWQFVSQKTGATLKYVGLTKEEVPDIEQLKGLLSNKTKIVVVHHVSNVLGSMLPIEEIVTWSKGVGAKVLVDACQSVPHMPVDVQKLGADFLVASSHKMCGPTGVGFMHGTFEILSSMEPFLGGGEMIADVFNDKSTYAEPPSRFEAGTPAIGEAIGLGAAIDYLSCIGMDQIHEYEKELATYLYESLISVPNVRVYGPAPSQTDHRAPLCSFNVENVHPTDIAEILDLQHGVAIRSGHHCAQILHRTLGINASARASLHFYNTKEEVDAFIDALKDTIHFLTSQH

SEQ ID NO: 10295 - protein, 462 aa, Setaria italica
MAAAAAAAAALRCCFPGSAIGSSFVRPSSCRRGRHAAAVASSSREAEPAASLGHLTRVDFPILHQEFDGAKLVYFDNGATSQKPFSVMKTLDEYYRSYNSNVHRGIHALSAKATDAYEGARRKVANFVNAADSREIIFTRNATEAINLVAYSWGLSNIKQGDEILLTVAEHHSSIVPWQIVSQKTGATLKYVGLTKEEVPDIEQLKGLLSNKTKMVVVHHVSNVLGSMLPIEEIVTWSKRVGAKVLVDACQSVPHMPVDVQKLGADFLVASSHKMCGPTGVGFMHGTFEMLSSMEPFLGGGEMIADVFYEKSTYAEPPSRFEAGTPAIGEAIGFGAAIDYLSCIGMDQIHEYEKELAMYLYESLLSVPNVRIYGPAPSQTDHRAPLCSFNVENVHPTDIAGILDLQHNVAIRSGHHCAQILHRTLGIDASARASLHFYNTKEEVDIFIHALKDTIDLLTSQH

SEQ ID NO: 10296 - protein, 473 aa, Hordeum vulgare
MATAAAVASLRYFPSSVRNCSYPGAISGGGGGGAVVTFSPRRGRCATAAVAAPSREAEPASSLGDLTRVDFPILDQEFDGNKLVYFDNGATSQKPSHVMKALDDYYRFYNSNVHRGIHALSAKATDAYESARRKVANFVNAADSREIIFTRNATEAINLVAYSWGLSNLKEGDEIILTVAEHHSAIVPWQFVSQKTGAVLKYVGLTKEEVPDIEQLKGLLSSKTKIVVVHHVSNVLGSMLPIEEVVSCANKVGAKVLVDACQSVPHMPVDVQKLGADFLVASSHKMCGPTGVGFLHGKFEILSSMEPFLGGGEMIADVLEDKSTYAEPPSRFEAGTPAIGEAIGLGVAIDYLSHFGMQRIHEYEKELGSYLYESLLSVPNVRIYGPAPSQSDHRAPLCSFNVENVHPTDIAEILDLQHGIAIRSGHHCAQILHRTLGINASARASLHFYNTKEEVDVFIHGLKATIDFLTSQH

SEQ ID NO: 10297 - protein, 472 aa, Festuca arundinacea
  misc_feature (8)..(8): Xaa can be any naturally occurring amino acid
  misc_feature (19)..(19): Xaa can be any naturally occurring amino acid
  misc_feature (24)..(24): Xaa can be any naturally occurring amino acid
  misc_feature (28)..(28): Xaa can be any naturally occurring amino acid
  misc_feature (59)..(59): Xaa can be any naturally occurring amino acid
MATAAAAXVASLRYFPSSXRNRVXPGTXSGGGAVTFSPRRGRGASAAAVAAPSREAEPXSSLGDLTRVDFPILDQEFDGNKLVYFDNGATSQKPSHVMKALDDYYRFYNSNVHRGIHALSAKATGAYEAARIKVANFVNAADSREIIFTRNATEAINLVAYSWGLSNLKQGDEIVLTVAEHHSAIVPWQFVSQKTGAVLKYVGLTKEEVPDIEQLKGLLSNKTKIVVVHHVSNVLGSMLPIEEIVACSKRVGAKVLVDACQSVPHMPVDVQKLGADFLVASSHKMCGPTGVGFLHGKFEILSSMEPFLGGGEMIADVFQDKSTYAEPPSRFEAGTPAIGEAIALGAAIDYMSHFGMQRIHEYEKELGAYLYESLLSVPKVQVYGPAPSQSDHRAPLCSFNVENVHPTDIAEILDLQHGVAIRSGHHCAQILHRTLGITASARASLHFYNTKEEVDVFIHGLKDTIDFLTSQH

SEQ ID NO: 10298 - protein, 235 aa, Secale cereale
MLPIEEIVSCANKVGAKVLVDACQSVPHMPVDVQKLGADFLVASSHKMCGPTGVGFLHGKFEILSSMEPFLGGGEMIADVFEEKSTYAEPPSRFEAGTPAIGEAIGLGVAIDYLSHFGMQRIHEYEKELGSYLYESLLSVPNVRIYGPAPSASDHRAPLCSFNVENVHPTDIAEILDLQHGVAIRSGHHCAQILHRTLGINASARASLHFYNTKEEVDVFIHGLKATIDFLTSQH

SEQ ID NO: 10299 - protein, 441 aa, Triticum aestivum
GAVVTFSPRRGRCATAAVAAPSREAEPASSLGDLTRVDFPILDQEFDGNKLVYFDNGATSQKPSHVMKALDDYYRFYNSNVHRGIHALSAKATDAYESARRKVANFVNAADSREIIFTRNATEAINLVAYSWGLSNLKQGDEIILTVAEHHSAIVPWQFVSQKTGAVLKYVGLTKEEVPDIEQLKGLLSSKTKIVVVHHVSNVLGSMLPIEEVVSCANKVGAKVLVDACQSVPHMPVDVQKLGADFLVASSHKMCGPTGVGFLHGKFEILSSMEPFLGGGEMIADVFEDKSTYAEPPSRFEAGTPAIGEAIGLGVAIDYLSHFGMQRIHEYEKELGSYLYESLLSVPNVRIYGPAPSASDHRAPLCSFNVENVHPTDIAEILDLQHGIAIRSGHHCAQILHRTLGINASARASLHFYNTKEEVDAFIHGLKATIDFLTSHH

SEQ ID NO: 10300 - protein, 471 aa, Triticum aestivum
MATAAAAAVASLRYFPSSVRNRSYPGTIGGGAVVTFSPRRGRCATAAVAAPSREAEPASSLGDLTRVDFPILDQEFDGNKLVYFDNGATSQKPSHVMKALDDYYRFYNSNVHRGIHALSAKATDAYESARRKVANFINAADSREIIFTRNATEAINLVAYSWGLSNLKQGDEIILTVAEHHSAIVPWQFVSQKTGAVLKYVGLTKEEVPDIEQLKGLLSSKTKIVVVHHVSNVLGSMLPIEEVVSCANKVGAKVLVDACQSVPHMPVDVQKLGADFLVASSHKMCGPTGVGFLHGKFEILSSMEPFLGGGEMIADVFEDKSTYAEPPSRFEAGTPAIGEAIGLGVAIDYLSHFGMQRIHEYEKELGSYLYESLLSVPNVRIYGPAPSASDHRAPLCSFNVENVHPTDIAEILDLQHGIAIRSGHHCAQILHRTLGINASARASLHFYNTKEEVDAFIHGLKATIDFLTSHH

SEQ ID NO: 10301 - protein, 469 aa, Oryza sativa
MVSAAAAASSLRCFPPSLGNRGPGAATARGGLVRLSSRRARSTAGVAAPSREAESAASLGDLTRVDFPILDQEFDGSKLVYFDNGATSQKPSCVMKTLDEYYRFYNSNVHRGIHVLSAKATDAYESARTKVANFVNAANSREIVFTRNATEAINLVAYSWGMSNLKQGDEIVLTIAEHHSAIVPWQFVSQKTGATLKYVGLTKEGVPDIEQLKGLLSNKTKIVVVHHVSNVLGSMLPIEDIVTWSNRIGAKVLVDACQSVPHMPVDVQRLGADFLVASSHKMCGPTGVGFLHGKFDLLSSMEPFLGGGEMIADVFQDKSTYAEPPSRFEAGTPAIGEAIGLGTAIDYLSQIGMQKIHEYENELATYLYESLIAVPNVRIYGPAPCQTVHRAPLCSFNVENVHPTDIAEILDLQHGVAIRSGHHCAQILHRTLGINASARASLHFYNTKEEVDVFVDALKDTIDFLTSEH

SEQ ID NO: 10302 - protein, 477 aa, Brachypodium distachyon
MATTAAAAAAAAASLRCFPSSSSSALRNRGPISNRGVGVVAFSPRRCASSVAAVAAPSREAEPASSLGDLARVDFPILDQEFDGNKLVYFDNGATSQKPSHVMKALDDYYRFYNSNVHRGIHALSAKATAAYENARIKVANFVNAADSREIIFTRNATEAINLVAYSWGLSNLKQGDEIVLTVAEHHSAIVPWQFVSQKTGAVLKYVGLTKEEVPDIEQLKGLISSKTKIVVVHHVSNVLGSMLPIEEIVTCSNRVGAKVLVDACQSVPHMPVDVQKLGADFLVGSSHKMCGPTGVGFLHGKYEILSSMEPFLGGGEMIADVFQDKSTYAEPPSRFEAGTPAIGEAIGLGAAIDYLSQFGMQRIHEYEKELGTYLYESLLSVPNVRIYGPSPSQSCHRAPLCSFNVENVHPTDIAEILDLQHGIAIRSGHHCAQILHRTLGINASARASLHFYNTKEEVDVFINGLKDTIEFLTSQH

SEQ ID NO: 10303 - protein, 648 aa, Glycine max
MTWQPSLLSQKRKTGTGPPLGLRNLGNSCYLNSVLQCLTYTPPLANFCLRLQHSSLCDSSASSCPFCILEKQIARSLRLDLTYDAPSKIQSCIRIFAENFRCGRQEDAHEFLRYVIDACHNTCLRLKKLRRKGAEANGGGGGDTGGGTVVKEIFGGALQSQVKCLCCGYESNKVDEIMDISLDVFHSNSLKDSMQKFFQPEVLDGNNKYKCDSCKKLVAAKKQMSILQAPNILVIQLKRFEGILGGKIDKAVAFEEVLVLSSFMCKASQDPQPEYKLFGTIVHSGYSPESGHYYAYIKDAMGRWYCCDDSCVTVATLQEVLSEKVYILFFSRTNQRPVASCNSLASNGVKPHSNGSQTSECPKVGVPPKAVHVKSNSELSPCKDMPSVSKTAKAPSSSRVKFDINGSSSKRNPAPVSVNGKVDVSRNQPSVINGHVKDSVSLENGKKDSSLPTSNGIDKNKVAVDKLKRKESTVTNGHTGNQTVDIHSVKSDLKEDTDRSRVIAGRVPDNFKHESNDLNNKPTILGNKRKLQEDPCILLAHDGQSQARVQELKDILGKEAKSVLRSCGWTDKVYEFMRSKKLHAQEAGNLTNGDEIRKLLIGDAQGAFISKIPESLKQDMIERLRSFSQEKKYNFQDLDPRMNVDLSC

SEQ ID NO: 10304 - protein, 643 aa, Cajanus cajan
MALQMTWQPSLLSQKRKTGPPLGLRNLGNSCYLNSVLQCLTYTPPLANFCLRLHHSSLCDSSASSCPFCILEKQIARSLRLDLPHDAPSKIQASLRIFGPHFRCGRQEDAHEFLRYVIDACHNTCLRIKKLHRKGGGGGGGGGGGGRGDVNAGGGGGGSTVVKEIFGGALQSQVKCLCCGYESNKVDEIMDISLDVFHSNSLRDSMQKFFQPEVLDGNNKYKCDSCKKLVAAKKQMSILQAPNILVIQLKRFEGILGGKIDKAVAFEEVLVLSSFMCKASQDPQPEYKLFGTIVHSGYSPESGHYYAYIKDAMGRWYCCDDSCVTVATLQEVLSEKVYILFFSRTNQRPVSSSNALASNGVKPHSNGSQASECPKVGVPLKAEHEKSNSELSPWKDMPSVSKTTKAPSSPRVKFDINGSSTSKRNPAPVSVNGKVDVSRSQPLVINGHVKDSVSLENGKKDPSSLLTRNGIDKLKRKEPAFTNGHTDNQTVDIHSVKSDPRENTDRSRVVASRGPDNFKQESNGLNSNPKILGNKRKVQEAPCILLAHDSESQARVQELKDILGKEAKSVLKSCGWTDMVCERMRSRKKKLREQEAGNFTNADETRKLLIGDAQGALTSQIPESLRKDLIERLRSFSQEKVHF

SEQ ID NO: 10305 - protein, 643 aa, Phaseolus coccineus
MALQMTWQPSLLSQKRKTGPPIGLRNLGNSCYLNSVLQCLTYTPPLANFCLTLQHSSLCDFSASSCPFCILEKQIARSLKLDLSHDAPSKIQSCIRIFAEHFRCGRQEDAHEFLRYVIDACHNTCLRLKKLRRKGGDANGGGGGDGGGSTVVKEIFGGALQSQVKCLCCGYESNKVDEIMDISLDVFHSNSLKDSMQKFFQPEVLDGNNKYKCDSCKKLVAAKKQMSVLQAPNILVIQLKRFEGILGGKIDKAVAFEEVLVLSSFMCKASQDPQPEYKLFGTIVHSGYSPESGHYYAYIKDAMGRWYCCDDSSVTVATLQEVLSEKVYILFFSRTNQRPVSNSISLASNGVKPHSNGNQASEFPKVGVPLKAVYAKSSFELSPWKDMPSVAKNAKVPSSSRVKFDINGSSTSKRSPAPVNVNGKVDVSRNQPLLINGHVKDSVFLENGKKDPSPLPTRNGIDKNKVDIDKFKRKESSLTNGHGDNQMVDIHSVKSDPREDTDKNRVIAGKGSDNFKLGKNGLSNKPKILGNKRKVHEDPCILLAHDGQSQARVQELKDNLGKEVKSYLISCGWTNVVYEFMRSIKKLRVQDGNLENGDETRKSLIRDAQVAFKSKIPESLRKDMIERIQSFIQENNTVLRTLI

SEQ ID NO: 10306 - protein, 538 aa, Hordeum vulgare
RGSPMTPSFSGRPSGFHSAGNFTAGTELVQPYKMYGQLGVPMQPPIPDPNFFQFFQHPSFPQYASGNQYNTLAPRGSVFGNVTDNFDPHKLFPQAQYPSDQRLQLPKTGISNSPTTLRGGTVPNYHGISPYVGAPLTYPTSPVFQGQPFSGISPSGRNDPARFQPASRNMTAVSGFQGQREREKFDSPKACTFLEELKSNRARRVELSDITGRIVDFSADQHGSRFIQQKLENCTAEEKAAVFAEVLPHASSLMTDVFGNYVIQKFFEHGTPEQRRDLAAKLAGHVVPLSLQMYGCRVIQKALEVMELDQKIDLVRELDGNIMRCVRDQNGNHVIQKCIECVPTEHIGFVVSAFRGQVASLSMHPYGCRVIQRVLEHCGGDSRGQCIIDEILQSACILAQDQYGNYVTQHVVEKGKSHERAQIISKLAGQVVTMSQNKFASNVIEKCFQHGDIAERDLLIREIVEQTDGNDTLLAMMKDQYANYVVQKILETCNDEQRELLVSRVKGHLQALRKYTYGKHIASRVEQLCGEGDAECDS

SEQ ID NO: 10307 - protein, 739 aa, Secale cereale
MATQSAVRLIGGGGAGGWTKDFGAFDSPLGNLPGEGLGFVENGSGIYGGWGESVPNRSGSAPPSMEGSLAALGNLIGQRSGNFDASLGNLDNVTGSSTAEEQLRADPAYFDYYGSKVNLNPRLPPPLISRESRRFMNRVGKVKEWRVVSQDDSNKGSLFIARSTLSTHKEEPEDDKSPRLDSSSADDEQMNLVDFVPESFQQNPDSLYSSSHLSSSSIGDGVAVHPNIDSSRNLSHDVVKPSGLNSWTPVPLASVLRSTLSNNLASTSVPSSSCSDNNPSVQISEQQQEKQSIDMKPGNDVPVSGAVVTELDVVDSSMKNLKLSLDSQTTPQVKQQWQGNFLQQYGFSPLVQGEHMPMTPHRAHLPHVPFVDNVSHTQLKLPTGDMQQLLPQLGMPTPFYAPNSFGSPYYQNLHPASVLANPYVTAGYALGGSGFPPVMTSYSPQSSAATPLDSPMTPSFSGRPSGFPSAGNLTAGTEFVQPYKMYGQLGVPMQPPIPDPNFFQFFQHPSFPQYASGNQYSTLAPRGSVFGNVADNFDPRKLFPQAQYPSDQRLQLPKTGISNSPTTLRGGTVPNYHGISPYVGAPLTYPTSPVFQGQPFSGMSPSGRNDSARFQSASRSMTAVSGFQGQREREKFDNPKACTFLEELKSNRARRVELSDITGRIVDFSADQHGSRFIQQKLENCTAEEKAAVFAEVLPHASSLMTDVFGNYVIQKFFDMELLSKEGILPPSLLVMLYL

SEQ ID NO: 10308 - protein, 1006 aa, Oryza sativa
MATESAVRLIGGTGSGNWSKDFGAFDSSLGSLSGEGLGFVDNNSGVYGGWRESVPNRSGSAPPSMEGSLAALGHMIGQQSGNLEATLGGKLGNVADSSKSEEQLRADPAYCDYYGSKVNLNPRLPPPLMSRESRRFMNRVGKVKEWRVVSQDDSNKGSLFIPRSTLSTHREEPEDDRSPRLDSSSAEDAQGSGKSGSNFDSHYTCMNLGDFASESFQQKAASLYDSSTHPSNSNTGDGISDHSDINSSTNFSIDAVKTSGLNSWTPVPVTNTVRSTHSNSISSTSVPSSSSPDNNPSMQTSQQEKPSIDIKHGNDVPGSGSILTELDTVNSNMKNLRISLDSHDTIHVKQQWPDNVLQQFGPSPLVQGDPIQMIPQGTHLPHVPFVENLSHTQLKLPTGDMQQFLPPPGMTTPFYAPNSFGSPYYQNLHPASVLPTPFGTAGYALSGSALPPVMTSYAPQVSVATPVDSPITPSFSGRPSGFPSPGNLSAGAEFVQPYKMYGQQLGVTMQPSVPDPNFFQFFQHPSLLSYAGINQYNTMGPRVSVVGNPADSFDPQKVLSQPAYPSDQRLQLPRTGIYNSPAARRGGAAPNYQGMTPYVGAPMTYPTSPVFQGQTFTGVFSPGRRNDSVRFQTPSRNMTAYSGVQGQREREKFDDPKACSFLEELKSNRARRVELSDIAGHIVEYSADQHGSRFIQQKLENCTAEEKASVFSEVLPHASSLMTDVFGNYVIQKFFEHGTPEQRRDLATKLVGHVLPLSLQMYGCRVIQKALEVMELDQKIELVRELDGNIMRCVRDQNGNHVIQKCIECVPTEHIGFVVSAFRGQVASLSMHPYGCRVIQRVLEHCGGDSQGQCIIDEILESACVLAQDQYGNYVTQHVLERGRGHERTQIISKLAGQVVTMSQNKFASNVIEKCFQHGDMTERDLLIREIVKQTEGNDNLLAMMKDQYANYVVQKILETCNEQQRELLLSRVKGHLQALRKYTYGKHIVSRVEQLCGEGDTESDS

SEQ ID NO: 10309 - protein, 993 aa, Sorghum bicolor
MATESAVRLIGGTGARDWSKGFGAFDSSVGGLSGEDLGFVDNGTGVYGGWSKSVPNRSGSAPPSMEGSLAALGHLIGQQSGSFEASLATLDNITDSSKSEEQLRADPAYFEYYGSKVNLNPRLPPPLISRESRRLMNRVGKAKEWRVVSQDNSSKGSIYVPRSTLSTHKEEPEDDKSPRLDSSSVEDAQIISSASNFQSQDFSLESFQQNAASLPDSSSSNPSNSNTGDSMPVYSDINLSRSLSVDAVKQSDLNSWKSKNPLKSNVSSDLSSPPLPSSSYSGSKTGMQTSQQEKAAVDTKHGNVVLGSGAAVTELDNVDSSMKNLKLSLDGHTSSPVKQRWQDNVLQQYGSFLQAQGDPIQMTTQGPHLPHIPFVDNLSHAQLKLPAGDLHQFLPQPSMTTPFYTPNSFGNPYYQNLHPANAFPTSIGTGGYAVSGSILPPFMAGYAPQGPLGTPLDSPMTPSFSGRPSGFPPAGNLTGGTDFMQSYKVYGQLGAGMQSSIPDPNFIHFFQHPSLFQYTSGNQYNTMGPRFTVVGNPAESFDPQKMIPQAAYPSDQRLPLPRTGFPNSTTPRRGTVPNYQGISSYVGVPMTYPTSPVFQGQTLPGVLPPGRRNDSVGFQSPSRNITDSPGIQGQRERQKFDESKTCSFLEELKSNRARRVELSDITGRIVEYSADQHGSRFIQQKLENCTAEEKAAVFAEVLPHASSLMTDVFGNYVIQKFFEHGTREQRRDLATKLVGHVLPLSLQMYGCRVIQKALEVMELDQKIDLVHELDGHVMRCVRDQNGNHVIQKCIECVPTEHIGFVVSAFQGQVASLSMHPYGCRVIQRVLEHCGGNSQGQCIIDEILQSACILAQDQYGNYVTQHVLERGKAHERSQIITKLAGQVVTMSQNKFASNVIERCFQHGDIAERDLLIRQIVEQTEGNDNLLAMMKDQYANYVVQKILETCNENQRELLLSRVKGHMQALRKYTYGKHIVSRVEQLCGDGTAESDS

SEQ ID NO: 10310 - protein, 551 aa, Panicum virgatum
ASYAPQGSLATPLDSPMTPSFSGRPSGFPSTGNPIGGTDFMQSYKMYGQLGVGMQPSIPDPNFIHFFQHPSLLQYTGGNQYNTMGPRFTVAGNPAESFDPQKMMPQTAYPSDQTLQLPRTGFPNSPTSRRGGVVPNYQAMSPYIGVPMSYPTSPVFQGQTLPGALPPGRRNDSVGFQSPTRNITANSGTQGQRERQKFDEPKACSFLEELKSNRARRVELSDITGRIVEYSADQHGSRFIQQKLENCTAEEKASVFAEVLPHAASLMTDVFGNYVIQKFFEHGTREQRRDLATKLVGHVLPLSLQMYGCRVIQKALEVMELDQKIDLVRELDGHVMRCVRDQNGNHVIQKCIECVPTEHIDFIVSAFQGQVASLSMHPYGCRVIQRVLEHCGGNSQGQCIIDEILQSACILAQDQYGNYVTQHVLERGKSHERSQIITKLAGQVVTMSQNKFASNVIEKCFQHGDIVERDLLIRQIVEQTEGNDNLLAMMKDQYANYVVQKILETCNESQRELLLSRVKGHLQALRKYTYGKHIVSRVEQLCGEGSADSGS

SEQ ID NO: 10311 - protein, 992 aa, Setaria italica
MATESAVRLIGGTGARDWSKGFGAFDSSVGGLSGEDLGFVDNGTGVYSGWRESVPNRSGSAPPSMEGSLAALGHLIGQQSGSFEASLASLDNMTDSSKSEEQLRGDPAYFEYYGSKVNLNPRLPPPLISRESRRLMNRVGKAKEWRVVSQDNSSKGSIYIPRSTLSTHKEEPEDDKSPRLDSSSVEDAQIISSTSNFESQDFMLESFQQSVASLPDSSYSNPSNNNTGDAMAARSDINLSRSLSVDAVKQSDLNSWTPKSPLKSTISNDLSSSPLSSSSYSGSKTGMQTSQQEKLAIDTKLGNAVLGSGAAVTELDNVESNMKNLKLSLDDHSSSSVKQKWQDNVLQQYGPLLPAQGDPIQMTPQGPHLSHVPFADNLAHTQLKLPTGDMQQFLPQLGMTTPFFTPNSFGSPYYQNLHPAAFPTSIGTGGYPVTGSVLPPFMGSYPPQGSLATPLDSPMTPSFSGRPSGFPSTGNPTGGTDFMQSYKMYGQLGVGMQPSIPDPNFIHFFQQPSLLQYNGGNQYNPMVPRFTVVGNPAESFDPQKMIPQTAYPSDQRLQLPRTGFPNSPTARRGGAVPNYPGMSPYVGVPMSYPTSPVFQGQTLPGALPPGRRNDSGFQSPSRNITANSGIQGQRERQKFDEPKACSFLEELKSNRARRVELSDITGRIVEYSADQHGSRFIQQKLENCTAEEKASVFTEVLPHAASLMTDVFGNYVIQKFFEHGTREQRRDLATKLVGHVLPLSLQMYGCRVIQKALEVMEIDQKIDLVRELDGHVMRCVRDQNGNHVIQKCIECVPTEHIGFIVSAFQGQVANLSMHPYGCRVIQRVLEHCGGNSQGQCIIDEILQSACILAQDQYGNYVTQHVLERGKAHERSQIITKLAGQVVTMSQNKFASNVIEKCFQHGDIAERDLLIRQIVEQTEGNDNLLAMMKDQFANYVVQKILETCNESQRELLISRVKGHLQALRKYTYGKHIVSRVEQLCGEGPAESDS

SEQ ID NO: 10312 - protein, 764 aa, Saccharum officinarum
MPVYSDINLSRSLSVDAVKQSDLNSWTPKSPLKSTVSSDLSSPPLSSSSYSGSKTGMQTSQQEKVAVDTKHGNVVLGSGAAVTELDNVDSSMKNLKLSLDGHTYSPVNQRWQDNVLQQYGSFPPAQGDPILMTTQGPHLPHIPFVDNLSHGQLKLPAGDMHQFLPQPSMTAPFYTPNSFGNPYYQNLHPANAFPTSIGTGGYAVSGSILPPFMAGYAPQGPLATPLDSPMTPSFSGRPSGFPPAGNLTGGTDFMQSYKVYGQLEAGMQPSIPDQDFIHFFQHPSLFQYTGGNQYNTMGPRFTVVGNPAESFDPQKMIPQAAYPSDQRLPLPRTGFPNSPTPRRGGTVPNYQGISSYVGVPMTYPTSPVFQGQTLPGVLPPGRRNDSVGFQSPSRNITDSPGIQGQRERQKFDESKTCSFLEELKSNRARRVELSDITGRIVEYSADQHGSRFIQQKLENCTAEEKASVFAEVLPHASSLMTDVFGNYVIQKFFEHGTREQRRDLATKLVGHVLPLSLQMYGCRVIQKALEVMELDQKIDLVHELDGHVMRCVRDQNGNHVIQKCIECVPTEHIGFVVSAFQGQVASLSMHPYGCRVIQRVLEHCGGNSQGQCIIDEILQSACILAQDQYGNYVTQHVLERGKAHERSQIITKLAGQVVTMSQNKFASNVIEKCFQHGDIAERDLLIRQIVEQTEANDNLLAMMKDQYANYVVQKILETCNENQRELLLSRVKGHMQALRKYTYGKHIVSRVEQLCGDGTAESDS

SEQ ID NO: 10313 - protein, 699 aa, Pennisetum glaucum
QQEKPAVDTKLGNAVLGSGAAVTTELDNVESNMKNLKLSLDGHSSSSVKQKWQDNVLQQYGPLFPAQGDPIQMTQGPHLTHVNLAHSQLKLPTGDMQQFLPQLGMTTPFFTPNSFGSPYYQNLHPAAFPTSIGTGGYPVTGSVLPPFIGSYPPQGSLATPLDNPMTPSFSGRPSGFPSAGNLTGGADFMQSYKMYGQLGVGMQPSIPDPNFIHYFQQPFLFQYNGGNQYNPMGPRFTVVGNPAEIFDPQKTIPQTAFLSDQRLPLPRTSFPNSPTARRGGAVPNYPGMSPYVGLPMSYPTSPVFQGQTLPGALPPGRRNDSVGFQSPSRNISANSGIQGQRERQKFDEPKACSFLEELKSNRARRVELSDITGRIVEYSADQHGSRFIQQKLENCTAEEKASVFTEVLPHAASLMTDVFGNYVIQKFFEHGTREQRRDLATKLVGHVLPLSLQMYGCRVIQKALEVMEIDQKIDLVRELDGHVMRCVRDQNGNHVIQKCIECVPTEHIGFIVSAFQGQVANLSMHPYGCRVIQRVLEHCGGNSQGQCIIDEILHSACILAQDQYGNYVTQHVLERGKDHERSQIITKLAGQVVTMSQNKFASNVIEKCFQHGDIAERDLLIRQIVEQTDGNDNLLAMMKDQFANYVVQKILETCNKSQRELLISRVKGHLQALRKYTYGKHIVSRVEQLCGEEPVESDS

SEQ ID NO: 10314 - protein, 986 aa, Zea mays
MATESAVRLIGGTGARDWSKGFGAFDSSVGALSGEDLGFVDNDAGVYGGWSKSVPNRSGSAPPSMEGSLAALGHLIGQQSGSFEASLATLDNITDSSKSEEQVLADPAYFEYYGSKVNLNPRLPPPLISRESRRLMNRVGKAKEWRVVSQDNSNKDSIYIPRSTLSTHKEEPEDDKSPRLDLSSVEDAQIISSASNFQSQDFMLESFRQSAASLPNSSSSNPSNINTGDSMPVYSDINLSVDAVKQSDLNSWTPKRPLKSTVSNDVSSLPLSSSSSYSGRKPGMQTSQQEKAAVDTKHGNVVLGSGAAVSELDNVDSSMNNLMISLDGHASSPVKQKWQDNVLWQYGSFLPAQGDPTQGIHLPHVPSIDNLSHAQLKLPAGDMHQFLPQPSMTTPFYTPNSFGNPYYPNLHPGNAFPTSIGTGGYAVSGSILPPFVAGFAPQGPLATPLDSPMTPSFSGRPSGFSPAGNLTGGTEFMQSYKVYGQPGAGMQPSIPDSNFIHFFQHPSLFQYTGGNQYNTMGPRFTVVNPTESFDPQKMIHQAAYPSDQRLPLPRTGFPNSPTSRRGGTVPNYQGISSYVGGPMTYPTSPVFQGQTLPGVLPPDRRNDPVGFQSPSRNITDSPGIQRQRDRQKFDESKTCSFLEELKSNRARRVELSDITGRIIEYSADQHGSRFIQQKLENCTAEEKAYVFAEVLPHASSLMTDVFGNYVIQKFFEHGTREQRRDLATKLVGHVLPLSLQMYGCRVIQKALEVMELDQKIDLVHELDGHVMRCVRDQNGNHVIQKCIECVPTEHIGFVVSAFQGQVASLSMHPYGCRVIQRVLEHCGGTSQSQCIVDEILQSACVLAQDQYGNYVTQHVLERGNAHERSQIIIKLAGQVVTMSQNKFASNVIEKCFQHGDMAERDLLIRQIVEQTEGNDNLLAMMKDQYANYVVQKILETCNENQRELLVSRVKGHMQALRKYTYGKHIVSRVEQLCGDGTAEPDS

SEQ ID NO: 10315 - protein, 455 aa, Triticum aestivum
GAVSDRAGSDKLRLQGGSDPKNNHLTIPRDGSSQNIAAQIFTFRELAAATKNFRQDCMLGEGGFGRVYKGRLESGQAVAVKQLDRNGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNILLGEGFHPKLSDFGLAKLGPVGDNTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPTQHTRSNSSTPRARNVGGRNSEQRNGRSPNHHSPRTSKHGGEVSRTSSTGGDSGRRSGLDEMDMAGSQAGSPAQTGRKRETPRTADRQRAIADAKMWGENSRERKRPNDSFDSTNE

SEQ ID NO: 10316 - protein, 439 aa, Triticum aestivum
GSDPKNNHLTIPRDGSSQNIAAQIFTFRELAAATKNFRQDCMLGEGGFGRVYKGRLESGQAVAVKQLDRDGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNILLGEGFHPKLSDFGLAKLGPVGDNTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPTQHTRSNSSTPRARNVGGRNSEQRNGRSPNHLSPRTSKHGGEVSRTSSTGGDSGRRSGLDEIDMAGSQAGSPAQTGRKRETPRIADRQRAIADAKIWGENSRERKRPNGSFDSTNE

SEQ ID NO: 10317 - protein, 460 aa, Saccharum officinarum
MSCFVCFGSAAQDGEVRKPPAAGAGKDAPPDRAVVRVGSDKSRSQGGPDSKKDLIIHRDGNSQNIAAQTFTFRELAAATKNFRQDCLLGEGGFGRVYKGRLENGQAVAVKQLDRNGLQGNREFLVEVLMLSLLHHTNLVSLIGYCADGDQRLLVYEFMPLGSLEDHLHDLPPDKEPLDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKVQGEQNLVAWARPLFKDRRKFPKMADPMLQGRFPMRGLYQALAVAAMCLQEQAATRPHIGDVVTALSYLASQAYDPNAPVQHSRSNSSTPRARNPAGWNEDQRSVRSPNNHHSPDPRRRDAARASKYGAEGSRTSSTSDSGRRSGLDDMDLTGSQVGSPAQTGRRRELQGH

SEQ ID NO: 10318 - protein, 490 aa, Secale cereale
MGCLPCFGSSGKGEPAKKGGARKDVPSDRRATGVGSDKPKPQGLLDSKKDTVIPREGNNQHIAAHTFTFRELAAATKNFRQDCLLGEGGFGRVYRGRLDNGQAVAVKQLDRNGLQGNREFLVEVLMLSLLHHDNLVNLIGYCADGDQRLLVYEYMPLGSLEDHLHDIPPEKEPLDWNTRMKIAAGAAKGLEYLHDKASPPVIYRDFKSSNILLGEEFHPKLSDFGLAKLGPVGDKTHVSTRVMGTYGYCAPEYAMTGQLTVKSDVYSFGVVFLELITGRKAIDNTKPHGEQNLVAWARPLFKDRRKFPKMADPALQGRFPMRGLYQALAVAAMCLQEQAATRPFIGDVVTALSYLASQAYDPNAATQHSRSNASTPRARDRGSVNGDQRRIRSPNHHSPDLRRKEVATTSKYEAEVSRNSSGGGSGRRSGLDDRDVTGSQQGSPAQAGKRRETSRTSERQRAIAEAKTWGENSRERKWPNVRGSFDSTNE

SEQ ID NO: 10319 - protein, 491 aa, Oryza sativa
MGCFPCFGSGGKGEAKKGGGGRKDGGSADRRVARVGSDKSKSQGGLDSRKDAFIPRDANGQPIAAHTFTFRELAAATKNFRQDCLLGEGGFGRVYKGHLENGQAVAVKQLDRNGLQGNREFLVEVLMLSLLHHDNLVNLIGYCADGDQRLLVYEFMPLGSLEDHLHDIPPDKEPLDWNTRMKIAAGAAKGLEFLHDKANPPVIYRDFKSSNILLGEGYHPKLSDFGLAKLGPVGDKTHVSTRVMGTYGYCAPEYAMTGQLTVKSDVYSFGVVFLELITGRKAIDNTKPLGEQNLVAWARPLFKDRRKFPKMADPLLAGRFPMRGLYQALAVAAMCLQEQAATRPFIGDVVTALSYLASQTYDPNTPVQHSRSNASTPRARNRVGANFDQRRLHSPNHQQSPDLRKEGTTTSKYEAEVSRTNSGSGSGRRAGLDSMDVTGSQMGSPAHAGRKRESSRSTDRQRAVAEAKTWGENSRERKWPNARGSFDSTNE

SEQ ID NO: 10320 - protein, 474 aa, Sorghum bicolor
MGCLPCFGSAGEGAAKKVGARKDGSSDRRVTRVESDKSKAHGGPDSKKDAVILRDGSNQHIAAHTFTFRELAAATKNFRQDCLLGEGGFGRVYKGRLENGQVVAVKQLDRNGLQGNREFLVEVLMLSLLHHDNLVNLIGYCADGDQRLLVYEFMPLGSLEDHLHDIPPEKEPLDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPHGEQNLVAWARPLFKDRRKFPKMADPLLQGRFPMRGLYQALAVAAMCLQEQAATRPFIGDVVTALSYLASQTYDPNAPVQHNRSNSSTPRVSRGGGSNDQRRLRSPNHHSPDLRREATAASKYEAEVSRTNSGSGSGRRSGLDDVDMSGSQLGSPAHAGRKRGSPRTAESQRAIAETKTCGEKSRGRK

SEQ ID NO: 10321 - protein, 475 aa, Panicum virgatum
MGCLPCFGSAGEGAAKKGGARKDGSSDRRVTRVGSDKSKPQGGSDSKKDAVILRDGNNQHIAAHTFTFRELAAATKNFRQDCLLGEGGFGRVYKGRLENGQVVAVKQLDRNGLQGNREFLVEVLMLSLLHHDNLVNLIGYCADGDQRLLVYEFMPLGSLEDHLHDIPPDKEPLDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPHGEQNLVAWARPLFKDRRKFPKMADPLLQGRFPMRGLYQALAVAAMCLQEQAATRPFIGDVVTALSYLASQTYDPNAPVQHSRSNSSTPRASRGGGSNDQRRLRSPNHHSPDLRRREATTGSKYEAEVSRTNSGSGSGRRSGLDDMDTAGLQLGSPGHAGRKRESSRTTERQLAVAEAKTWGENSRDRN

SEQ ID NO: 10322 - protein, 350 aa, Sorghum bicolor
MLSLLHHDNLVNLIGYCADGDQRLLVYEFMPLGSLEDHLHDIPPEKEPLDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPHGEQNLVAWARPLFKDRRKFPKMADPLLQGRFPMRGLYQALAVAAMCLQEQAATRPFIGDVVTALSYLASQTYDPNAPVQHNRSNSSTPRVSRGGGSNDQRRLRSPNHHSPDLRREATAASKYEAEVSRTNSGSGSGRRSGLDDVDMSGSQLGSPAHAGRKRGSPRTAESQRAIAETKTCGEKSRGRK

SEQ ID NO: 10323 - protein, 475 aa, Setaria italica
MGCLPCFGSAGEGAAKKGGARKDGSSDRRVTRVGSDKSKPQGGSGSKKDAVILREGNNQHIAAHTFTFRELAAATKNFRQDCLLGEGGFGRVYKGRLENGQVVAVKQLDRNGLQGNREFLVEVLMLSLLHHDNLVNLIGYCADGDQRLLVYEFMPLGSLEDHLHDIPPDKEPLDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNGKPHGEQNLVAWARPLFKDRRKFPKMADPLLQGRFPMRGLYQALAVAAMCLQEQAATRPFIGDVVTALSYLASQTYDPNAPVQHNRSNSSTPRASRGGGSNDQRRLRSPNHHSPDLRRREATTGPKYEAEVSRTNSGSGSGRQSGLDDVDMTVSQLGSPGHGGRKRESPRTAERQGAIAEAKTWGENSRGRN

SEQ ID NO: 10324 - protein, 398 aa, Secale cereale
MSCFFCFGPAVEAEAGKPGPDAKDPRAAAPDRAGSDKLRLQGGSDPKNNHLALPRDGSSQNIAAQIFTFRELAAATKNFRQDCMLGEGGFGRVYRGRLESGQAVAVKQLDRNGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNILLGEGFHPKLSDFGLAKLGPVGDNTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPINILGAIHRPRGPEMSVGGTANSATAARQIIIL

SEQ ID NO: 10325 - protein, 350 aa, Zea mays
MLSLLHHDNLVNLIGYCADGDQRLLVYEFMPLGSLEDHLHDIPPDKEPLDWNTRMKIAAGAAKGLEYLHDKASPPVIYRDFKSSNILLGEGFHPKLSDFGLAKLGPVGDKTHVSTRVMGTYGYCAPEYAMTGQLTAKSDVYSFGVVFLELITGRKAIDNTKPHGEQNLVAWARPLFKDRRKFPKMADPSLQGCFPMRGLYQALAVAAMCLQEQAATRPFIGDVVTALSYLASHTYDPNAPAQHNRSNSSTPRVSRGGGSNDQRRLRSSNHHSPDLRREVTTASRYDDEVSRANSGTGSGRRSGLDDADMSGSQLGSPAHTGRKRGSPRTSESQHAIAEAKTYGENSRGRK

SEQ ID NO: 10326 - protein, 268 aa, Triticum aestivum
YDIDCVPDAYRSNKQAYIKDSSISKKCIQKVKVQYHMKAPIYVYYELDNFYQNHRRYIKSRSDKQLRHGLQYTDSSCSPIERSNGLPVVPCGLIAWSLFNDTYDFTRGSMGLMVDRKNISWRSDREHKYGKDVYPFNFQNGSLIGGGKLDPDIPLSNQEDLIVWMRAAALPQFRKLYGVIEEDIQADETITMHITNNYNTYSFGGKKSLVLTTSTWLGGKNDFLGYAYLITGSSSIFLCILFALIHVKIPRPHGDAAYLSWSRKNGNN

SEQ ID NO: 10327 - protein, 253 aa, Lolium multiflorum
QAYIKDSSISKKCIQKVQVRYRMKAPIYVYYELDNFYQNHRRYVKSRSDKQLRRGLEHTESSCSPIERSNGLPIVPCGLIAWSLFNDTYGFTRGSKDIMVDRKNISWRSDREHKFGKDVYPFNFQNGSLIGGGKLDPNVPLSNQEDLIVWMRTAALPQFRKLYGVIEEDIQADETITMHITNNYNTYTFGGKKSLVLTTSSWLGGKNDFLGYAYMITGSLSIFLSILFALIHVKVPRPHGDAAYVSWSRTKQQ

SEQ ID NO: 10328 - protein, 280 aa, Triticum aestivum
QASNRVAEIVHRYDIDCVPNAYRSNKQAYIKDSSISKKCIQKVKVQYHMKAPIYVYYELDNFYQNHRRYIKSRSDKQLRHGLQYTDSSCSPIERSNGLPVVPCGLIAWSLFNDTYDFTRGSMGLMVDRKNISWRSDREHKYGQDVYPFNFQNGSLIGGGKLDPDIPLSNQEDLIVWMRAAALPQFRKLYGVIEEDIQADETITMHITNNYNTYSFGGKKSLVLTTSTWLGGKNDFLGYAYLITGSSSIFLCILFALIHVKIPRPHGDAAYLSWSRKNGNN

SEQ ID NO: 10329 - protein, 554 aa, Triticum aestivum
KISWLEAKMDARSLFDEFVQDESGQLEAHWLVRRCKELWAMAAQRFGFTDDERLRKLQTRKLVIGSRLSDYKEGRAPGAGIAFIVFKDVYTANKAVRDFRMERKKTPIGRFFPVMELQLERSRWRVERAPPASDIYWNHLGMNKTSLALRRIAVNTCLIVMLLFFSSPLSILSGMQNAARIINVEAMDNAKSWIVWLQGSSWFWTIIFQFLPNVLIFVSMYIIIPSVLSYFSKFEFHLTVSGEQRAALLKMVCFFLVNLILLRALVESSLESWILSMGRCYLDSADCKQIEHYLSPSFLSRSSLSSLAFLITCTFLGISFDLLAPIPWIKHILKKFRKNDMVQLVPEENEEYRSMNNDEETNGLVSPLMSEREDSDILNGFEGHDLSMYPINRSFHMPKQKFDFAQYYAFDITIFALTMIYSLFAPLVVPVGAVYFGYRYLVDKYNFLFVYRVRGFPAGNDGKLMDRVLCIMQFCVIFFLAAMLLFFAVQGDSMKLQAICTLGLLVFYKLLPSGSDRFQPSLLEGMQSVNSFVDGPTDYEVFSQPDLDWNLYQS

SEQ ID NO: 10330 - protein, 560 aa, Secale cereale
WGKVRNKISWLEAKMDARSLFDEFVQDESGHLEAHWLVRRCKELWAMAAQRFGFTDDERLRKLQTSKLVIGSRLSDYKEGRAPGAGIAFVVFKDVYTANKAVRDFRMERKKTPIGRFFPVMELQLERSRWRVERAPPASDIYWNHLGMNKTSLALRRIAVNTCLIVMLLFFSSPLSILSGMQNAARIINVEAMDNAKSWIVWLQGSSWFWTIIFQFLPNVLIFVSMYIIIPSVLSYFSKFEFHLTVSGEQRAALLKMVCFFLVNLILLRALVESSLESWILSMGRCYLDSADCKQIEHYLSPSFLSRSSLSSLAFLITCTFLGISFDLLAPIPWIKHILKKFRKNDMVQLVPEENEEYRSVDNGEETNGLISPLMSEREDSDILNGFEGHDLSMYPINRSFHMPKQKFDFAQYYAFDITIFALTMIYSLFAPLVVPVGAVYFGYRYLVDKYNFLFVYRVRGFPAGNDGKLMDRVLCIMQFCVIFFLAAMLLFFAVQGDSMKLQAICTLGLLVFYKLLPSGSDRFQPSLLEGMQTVNSFVDGPTDYEVFSQPDLDWNLYQS

SEQ ID NO: 10331 - protein, 504 aa, Secale cereale
GPLREYFEHKYPGKVYRVIVPFDLCTLEYLADEWGKVRNKISWLRQDGRRSLFDEFVQDESGHLEAHWLVRRCKELWAMAAQRFGFTDDERLRKLQTSKLVIGSRLSDYKEGRAPGAGIAFVVFKDVYTANKAVRDFRMERKKTPIGRFFPVMELQLERSRWRVERAPPASDIYWNHLGMNKTSLALRRIAVNTCLIVMLLFFSSPLSILSGMQNAARIINVEAMDNAKSWIVWLQGSSWFWTIIFQFLPNVLIFVSMYIIIPSVLSYFSKFEFHLTVSGEQRAALLKMVCFFLVNLILLRALVESSLESWILSMGRCYLDSADCKQIEHYLSPSFLSRSSLSSLAFLITCTFLGISFDLLAPIPWIKHILKKFRKNDMVQLVPEENEEYRSVDNGEETNGLISPLMSEREDSDILNGFEGHDLSMYPINRSFHMPKQKFDFAQYYAFDITIFALTMIYSLFAPLVVPVGAVYFGYRYLVDKYNFLFVYRVRGFPAGNDGKPDG

SEQ ID NO: 10332 - protein, 453 aa, Pennisetum glaucum
ERKKTPIGRFFPVMELQLERSRWKVERAPPASDIYWNHLGLSKISSRLRRIAVNTCLLLMLLFFSSPLAIISGMQSAARIINVEAMDHAKSWLAWLEGSSWFWTIIFQFLPNVLIFVSMYIIIPSVLSYFSKFECHLTVSGEQRAALLKMVCFFLVNLILLRALVESSLESWILSMGRCYLDGPDCKQIEHYLSPSFLSRSSLSSLAFLITCTFLGISFDLLAPIPWIKHIMKKFKKNDMVQLVPEENEDYLMMQNGEETNNLAAPLIPEREDSGLLDSIEGHDLSLYPLNRSFHMPKQKFDFAQYYAFDITIFALTMIYSLFAPLVVPVGAAYFGYRYLVDKYNFLFVYRVRGFPAGNDGKLMDRVLCIMQFCVIFFLAAMLLFFAVQGDSMKLQAICTLGMLVFYKLLPSRSDRFQPSLLEGMQTVNSFVDGPTDYEAFSQPDLDWNMYQS

SEQ ID NO: 10333 - protein, 220 aa, Pseudoroegneria spicata
  misc_feature (11)..(12): Xaa can be any naturally occurring amino acid
KFRKNDMVQLXXEENEEYRSMNNGEETNGLISPLMSEREDSDILNGFEGHDLSMYPINRSFHMPKQKFDFAQYYAFDITIFALTMIYSLFAPLVVPVGAVYFGYRYLVDKYNFLFVYRVRGFPAGNDGKLMDRVLCIMQFCVIFFLAAMLLFFAVQGDSMKLQAICTLGLLVFYKLLPSGSDRFQPSLLEGMQTVNSFVDGPTDYEVFSQPDLDWNLYQS

SEQ ID NO: 10334 - protein, 217 aa, Leymus cinereus x Leymus triticoides
RCCRVQLVPEENEEYRSMHNGEETNGLISPLMSEREDSDILNGFEAHDLSMYPINRSFHMPKQKFDFAQYYAFDITIFALTMIYSLFAPLVVPVGAAYFGYRYLVDKYNFLFVYRVRGFPAGNDGKLMDRVLCIMQFCVIFFLAAMLLFFAVQGDSMKLQAICTLGLLVFYKLLPSGSDRFQPSLLEGMQTVNSFVDGPTDYEVFSQPDLDWNLYQS

SEQ ID NO: 10335 - protein, 532 aa, Triticum aestivum
MAAATTMTWHEELATLVGDTGARLPAAAAPAPNSAAAVGAGWYGEEEEGKMEEGWAQQARGFAESTAEMLRELGLGVWDVAAQSLAGAEDSELARRLRRPAAAAGKRLSFMNEYLPEDRDPVRCWAVVAAVAFVALLVLGVGSSDDTPVEQPKKLYISPPNAKRFQLPDGRHLAYEEKGISADRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMANPYDSKMTKDEKRKIWDRWSTKRKLMHILARRFPSLLRLFYHRSFLSGKQGQPESWLSLSMGKKDKTLLEAPTFNAFWEKDVAESVRQGDAQPFVEEAVLQVSDWGFSLSDIQMQKKEDQGVFEFIKSLFSQAEREWVGFLGPIHIWQGMDDRVVPPSATEFARRMVPGATVHKLLDEGHFSYFCFCDECHRQIFSTLFGTPQGPLNPAPESSEAAPEPAEETSPAYDEEVAEQEQETSGLA

SEQ ID NO: 10336 - protein, 531 aa, Triticum aestivum
MAAATTMTWHEELATLVGDTGARLPAAAAPAPNSAAAVGAGWYGEEEEGKMEEGWAQQARGFAESTAEMLRELGLGVWDVAAQSLAGAEDSELARRLRRPAAAAGKRLSFMNEYLPEDRDPVRCWAVVAAVAFVALLVLGVGSSDDTPVEQPKKLYISPPNAKRFQLPDGRHLAYEEKGISADRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMANPYDSKMTKDEKRKIWDRWSTKRKLMHILARRFPSLLRLFYHRSFLSGKQGQPESWLSLSTGKKDKTLLEAPTFNTFWEKDVAESVRQGDAQPFVEEAVLQVSDWGFSLSDIQMQKKEDQGVFEFMKSLFSQAEREWVGFLGPIHIWQGMDDRVVPPSVTEFARRMVPGATVHKLLDEGHFSYFCFCDECHRQIFSTLFGTPQGPLNPAPESSEVAPEPAEETSPAYEEVAEQEQETSGLA

SEQ ID NO: 10337 - protein, 537 aa, Brachypodium distachyon
MAAAKTMTWHEELATLVGDTGVRLPGVGVDAAPAPAGVNRAAVGGRWYGEEEEEGKVEEGWAQQARGFAESTAEMLRELGLGVWDVAAQSLAGAEDSELARRLRRPAAAAGKRLSFMNEYLPEDRDPVRCWLVVAAVAFVALLVLGAGTGDETPVEQLRKLYISPPNAKRFQLPDGRHLAYEEKGVSAERARFSLIAPHSFLSSRLAGIPGINTSLLEEFGARLVTYDLPGFGESDPHPGRNLNSSALDMLHLADALGVADKFWVVGYSGGGMHAWSALRYIPDRVAGAAMFAPMANPYDSKMTKDEKRKTWDRWSTKRKLMHILARRFPSLLRLFYLRSFLSGKQGQPESWLSLSLGKKDKALLEGAMFNAFWEKDVAESVRQGDAKPFVEEAVMQVSDWGFSLSDIQMQKKEDQGLFELIKSLFSQAEREWVGFLGPIHIWQGMDDRVVPPSVTEYVRRMVPGATVHKLLDEGHFSYFCFCDECHRQIFSTLFGIPQGPISPVQESGEVAPEFAEETTASEEFAEQEQDTSECLA

SEQ ID NO: 10338 - protein, 537 aa, Panicum virgatum
MSAASTMMWHEDLATLVGDTGAHLHGAGGEAPAAAANVAAAGAGWYGEEEEGRAEEGWAQQAKGFAESTAEMLRELGRGLWDVAAQSLAGAEDSELARRLRKRAAATGERLSFMNEYLPEERDPVRCWLIVAAVAFVTLLVLGVGSGDEIPVELPKKLIISPPSANRIQLPDGRHLAYEEQGVSADRARFSLIAPHSFLSSRLAGIPGISASLLEEFGARLVTYDLPGFGESDLHPGRNLNSSALDMLHLADALGIPDKFWVVGYSGGGMHAWSALRYIPDRVAGAAMFAPMANPYDSKMTKDERHKTWDRWSTKRKLMHILARRFPSLLPLFYRRSFLSGKQGQPESWLSLSLGKKDKTLLEGPEFNAFWERNVAESVRQGDARPFVEEAVLQVSDWGFSLSDIQMQKKEDQSFFELIKSLFNQVEREWVGFLGPIHIWQGMDDRVVSPSVAEFIRRVVPGATVHKLLDEGHFSYFCFCDECHRQIFSTLFGIPQGPINPAPLPSDVASELAEETTEETTAPDNLTEEEQGKSSLA

SEQ ID NO: 10339 - protein, 536 aa, Oryza sativa
MAAAATMTWHEELATLVGDTGVRFPGAGGGSAANVAAAVGGGWYRGEEEDGEGRAVEEEGWAQQARGFLESTAEMLRVLGRGLWDIAAQSLAGAEDSELARRLRGPAAAAGKRLSFMNEYLPEDRDPVWCWVVVAAVAFVTLIVLGVGSVDDTPVELPKKLYIGPPSAKTIQLPDGRHLAYKEQGVTADRARFSLIAPHSFLSSRLAGIPGIKPSLLEEFGARLVTYDLPGFGESDPHPGRDLNSSAHDMLHLAGALRIVDKFWVVGYSAGSIHAWSALRHIPDRVAGAAMFAPMANPYDSKMTKEERRKTWERWSTKRKLMHILARRFPALLPLFYHRSFLSGKQGQPESWLSLSLGKKDKTSLESPMFNAFWEKDVAESVRQGDAQPFVEEAVLQVSDWGFSLSDIQMQKREDLSFFELIKSLFRQAEREWVGFLGPIHIWQGMDDRVVPPSVTEYVRRVVPGATVHKLLDEGHFSYFCFCDECHRQIFSTLFGIPQGPINPVPEPIEVASELTEETTVPDKAKEEEQDISDLA

SEQ ID NO: 10340 - protein, 532 aa, Setaria italica
MSAAATMTWHEDLATLVGDTGARFPGAGGDAPAAANVAAAGAGWYGEEEEGRTEEGWAQQAKGFAESTAEMLLELGRGLWDVAAQSLAGAEDSELARRLRKRAAATGERLSFMNEYLPEERDPVRCWLIVAGVAFVTLLVLGVGSGNETPVELPKKLIISPPSANRIQLPDGRYLAYEEQGVSADRARFSLIAPHSFLSSRLAGIPGISASLLEEFGARLVTYDLPGFGESDPHPGRNLNSSALDMLHLANGLDIPDKFWVVGYSGGGMHAWSALRYIPDRVAGAAMFAPMANPYDSKMTKDERHKTWDSWSTKRKLMHILARRFPSLLPLFYRRSFLSGKQGQAESWLSLSLGKKDKTLLDGPEFNAFWERNVAESVRQGDARPFVEEAVLQVSDWGFSLSDIQMQKKEDRGFFELIKSFFNQVEREWVGFLGPIHIWQGMDDRVVSPSVAEFVRRVVPGATVHKLLDEGHFSYFCFCDECHRQIFSTLFGIPQGPINPAPQPSELASELAEETTAPDNVTEQEQGKSSLA

SEQ ID NO: 10341 - protein, 532 aa, Sorghum bicolor
MSAAATMTWHEDLATLVGDTGVRLPGGGGHAPAAANVAAAGAGWYGEEEEGRAEEGWAQQAKGFAESTAEMLRELGRGLWDVAAQSLAGAEDSELARRLRKRAAATGKRLSFMNEYLPEERDPVRCWLIVAAVAFVTLLVLGAGSDNETPVDLPKKLIIGPPSADRIQLPDGRHLAYEEQGVSANRARFSLIAPHSFLSSRLAGIPGISASLLEEFGVRLVTYDLPGFGESDPHLGRNLNSSALDMLYLANALNIPEKFWVVGYSGGGMHAWSALRYIPDRVAGAAMFAPMANPYDSKMTKDERRKTWDSWSTKRKLMHILARRFPSLLPFFYRQTFLSGKQGQPESWLSLSLGKKDKTLLEGPVFNAFWERNVAESVRQGDARPFVEEAVLQVSDWGFSLSDIQMQKKEARGIFELIKSLFNQAEREWVGFLGPIHIWQGMDDRVVSPSVAEFVRRSVPGATVHKLLDEGHFSYFCFCDECHRQIFSTLFGIPQGPINPAPQPSEVVSELTEETTVPDNATDQEQGKSGLP

SEQ ID NO: 10342 - protein, 637 aa, Triticum aestivum
MPSTSSSSRPPILHPSSKTPNTPRLLPLVSRAAAPRPLLLSFAPPAPGRGLRTAAAQQPAYENGEEEEEGVEDDEYYSDEEDEGELDVEAMEEEARRAAADLAARLDRELRVDGDVREKRRTMRDKTSTSKHIPDSKLPKVAVIGRPNVGKSALFNRLVGGNRAIVVDEPGVTRDRLYGRSYWGDQEFMVIDTGGVITLSKSQAGVMEELAITTTVGMDGIPMASREAAIARMPSMIEKQAVAAVEEAAVLLFLVDGQAGLVAADIEIADWLRRNFSHKCIILAVNKCESPRKGQMQALEFWSLGFTPLPISAITGTGTGELLDMVCSELKKFEGLEGLDDVEEDENRVPAISIVGRPNVGKSSILNALVGEDRTIVSPVSGTTRDAIDTELTTVDGQKYKLIDTAGIRRRAAVASAGSTTETLSVKRAFSAIRRSDVVALVIEAMACVSEQDYKIAERIEKEGKACVIVVNKWDTIPNKNNESTTHYEQDVREKLRVLDWAPIVYCSAINGNSVEKIISAASLVEKERSRRLGTSILNQVVREAVAFKAPPRTRGGKRGRVYYTTQAAVRPPTFVLFVNDAKLFPEPYRRYMHKQLRSDAGFPGTPIRLLWRSRKRTDRQQRRSNTEARGALVAAS

SEQ ID NO: 10343 - protein, 648 aa, Hordeum vulgare
MAMPSTPSSSRPPMLHPASKTPNPPRLLPLVTRGAAAPRPPLLISFAPPAPGRRGLRAAAAQQPAYEDGEEEEDGEEDGECYSEEEEEDEEELDVEAMEEEARRAAADLAARLDRELRVDGDVREKRRTMRDKTSTTSKHIPDSKLPKVAIIGRPNVGKSALFNRLVGGNRAIVVDEPGVTRDRLYGRSYWGDQEFMVIDTGGVITLSKSQAGVMEELAITTTVGMDGIPMASREAAIARMPSMIEKQAVAAVEEAAVLLFLVDGQAGLVAADIEIADWLRRNFSHKCIILAVNKCESPRKGQMQALEFWSLGFSPLPISAITGTGTGELLDMVSSELKKFEALQGLEGLDDVEEDENRVPAISIVGRPNVGKSSILNALVGEDRTIVSPVSGTTRDAIDTELTTEDGQKYKLIDTAGIRRRAAVASAGSTTETLSVKRAFSAIRRSDVVALVIEAMACVSEQDYKIAERIEKEGKACVIVVNKWDTIPNKNNESTTHYEQDVREKLRVLDWAPIVYCSAINGNSVEKIISAASLVEKERSRRLGTSILNQVIREAVAFKAPPRTRGGKRGRVYYTTQAAVRPPTFVLFVNDAKLFPEPYRRYMHKQLRSDAGFPGTPIRLLWRSRKRTDRQQRRSNTEARGALVAAS

SEQ ID NO: 10344 - protein, 637 aa, Triticum aestivum
MPSTSYFSRPPIVHPSSKTPNTPRLLPLVSRAAAPRPLLPSFAPPAPGRGLRTAAAQQPAYENGEEEEEGVEDDEYYSDEEDEGELDVEAMEEEARRAAADLAARLDRELRVDGDVREKRRTMRDKTSTSKHIPDSKLPKVAVIGRPNVGKSALFNRLVGGNRAIVVDEPGVTRDRLYGRSYWGDQEFMVIDTGGVITLSKSQAGVMEELAITTTVGMDGIPMASREAAIARMPSMIEKQAVAAVEEAAVLLFLVDGQAGLVAADIEIADWLRRNFSHKCIILAVNKCESPRKGQMQALEFWSLGFTPLPISAITGTGTGELLDMVCSELKKFEGLEGLDDVEEDENRVPAISIVGRPNVGKSSILNALVGEDRTIVSPVSGTTRDAIDTELTTVDGQKYKLIDTAGIRRRAAVASAGSTTETLSVKRAFSAIRRSDVVALVIEAMACVSEQDYKIAERIEKEGKACVIVVNKWDTIPNKNNESTTHYEQDVREKLRVLDWAPIVYCSAINGNSVEKIISAASLVEKERSRRLGTSILNQVVREAVAFKAPPRTRGGKRGRVYYTTQAAVRPPTFVLFVNDAKLFPEPYRRYMHKQLRSDAGFPGTPIRLLWRSRKRTDRQQRRSNTEARGALVAAS

SEQ ID NO: 10345 - protein, 421 aa, Triticum aestivum
MPSTSYFSRPPIVHPTSKTPNPPRLLPLVSGAAAPRPLLPSFAPPAPGRGLRTAAAQQPAYENGEEEEEGEEDEEYYSEEEDEEELDVEAMEEEARRAAADLAARLDRELRVDGDVREKRRTMRDKTSTSKHIPDSKLPKVAVIGRPNVGKSALFNRLVGGNRAIVVDEPGVTRDRLYGRSYWGDQEFMVIDTGGVITLSKSQAGVMEELAITTTVGMDGIPMASREAAIARMPSMIEKQAVAAVEEAAVLLFLVDGQAGLVAADIEIADWLRRNFSHKCIILAVNKCESPRKGQMQALEFWSLGFTPLPISAITGTGTGELLDMVCSELKKFEGLEELDDVEEDENHVPAISIVGRPNVGKSSILNALVGEDRTIVSPVSGTTRDAIDTELTIKDGAEIQTHRYGWHPTESSSCFCWQHN

SEQ ID NO: 10346 - protein, 667 aa, Hordeum vulgare
MLLSPSVPRCPRPRALRRAMAMPSTPSSSRPPMLHPASKTPNPPRLLPLVTRGAAAPRPPLLISFAPPAPGRRGLRAAAAQQPAYEDGEEEEDGEEDGECYSEEEEEDEEELDVEAMEEEARRAAADLAARLDRELRVDGDVREKRRTMRDKTSTTSKHIPDSKLPKVAIIGRPNVGKSALFNRLVGGNRAIVVDEPGVTRDRLYGRSYWGDQEFMVIDTGGVITLSKSQAGVMEELAITTTVGMDGIPMASREAAIARMPSMIEKQAVAAVEEAAVLLFLVDGQAGLVAADIEIADWLRRNFSHKCIILAVNKCESPRKGQMQALEFWSLGFSPLPISAITGTGTGELLDMVSSELKKFEALQGLEGLDDVEEDENRVPAISIVGRPNVGKSSILNALVGEDRTIVSPVSGTTRDAIDTELTTEDGQKYKLIDTAGIRRRAAVASAGSTTETLSVKRAFSAIRRSDVVALVIEAMACVSEQDYKIAERIEKEGKACVIVVNKWDTIPNKNNESTTHYEQDVREKLRVLDWAPIVYCSAINGNSVEKIISAASLVEKERSRRLGTSILNQVIREAVAFKAPPRTRGGKRGRVYYTTQAAVRPPTFVLFVNDAKLFPEPYRRYMHKQLRSDAGFPGTPIRLLWRSRKRTDRQQRRSNTEARGALVAAS

SEQ ID NO: 10347 - protein, 1087 aa, Secale cereale
MEVSASASTPQALTLLTCPPCFLSLYPSVRLHGRAGGGGLLLRHPPQRRLELGYRARRPVGCSLSGSSSTALDVLGGSVGAAAAVLAALQLVWLRWRGAMHRESPEVLHTQVKSIVNKALRTTTQSVHDSNDARCATHENSFSELSISEGMTINELECRASISCIYPVNKTTQAVSVTNPGAMLHTLVDVSRQEEVGCSTSAEKRNSTENVIDVLATPYSGPPGQHKSKYFSNRIGWQGGLSYQFLSLSELQKDAQNGNGLGDSQTNSNNAHLFRCHQSNDDENIDLTSLSSFKRTVECPLNFVPQASIGNLFRPRKAIGFADSYVGGSHLTPGKLALFACLREGPASKQQKAVKDHDDAKTIGWSISDILHKENLDNFIPATTAGLNGTVDTSDYMRRYKSSLMDGRLKDCVDLLESMEQKGLLDTKKIHHASFLSACKKQRAVMEAVRFCRLIENPKMSTFNMLLSVCANSKDFEGALQVMVLLKEAGLKPDCKLYTTLISTCAKCGKVDAMFEVFHEMVSAGIEPNVNTYGALIDGCAKAGQVAKAFGAYGIMSSKKVKPDRVVFNALISACGESGAVARAFDVLSEMTAESSESKGCKPILPDHVTVGALMKTCIQAGQADRAREVYKMLQEYSIKGTPEVYTIALRSCSLTGDLGFALKIYEDMNKIGVQPDEMFLSALVDVAGHARRADAAFEIIKDVRAKGFHVGIMAYSSCMGACCNAKDWKKALQLFEEIKAIKLIPTVPMMNALITSLCDGDQVLKSAEVLNEIKELGVRPNEITYSVLCVACERNGEAQLALDLFEQLKLDGIVLNPTIVGCLTGLCLQMFSYDLSLGNIIVRFNQGKPQIDNKWTSSAIMVFRQAITAGLLPSSDVLSQVLGCLRFPHDSSLKTTFIDNMGISCDMPHHPNTNSLLEGFGEYDIRAFSVLEEGGLLGAVASTSTKYSQIVIDARKSNIYTAEVSLLSTLKSLKHRLAAGARLPNVTILLPTEKKQVDLDEREKTLKLAGRVGQAVGSLLRRLGIKYQGEESHGRMRINGLTLRRWFNPKFTSAPSTGAPVELLPLPSRLAKGIADQQRDIRSLSL

SEQ ID NO: 10348 - protein, 466 aa, Triticum aestivum
MPTPMATRPTSTMAAKLPAPSTPRQCYLLPGRRAGLARGAPSASSKKRNPWLDPFDDGPDEEFDYTGVYSGGKQEEDPRPPEDAENPYGFLRFPMGYMPELDSLASKVRGDVRRVCCVVSGGVYENVLFFPVVQMLKDRYPGVLVDVVASARGKQVYEMCKNVRYANVYDPDDEWPEPAEYTHQLGVMKNRYYDMVLSTKLAGTGHALFLFMSSAREKVGYVYPNVNGAGAGLFLTEMFKPATTNLADGGYNMYQDMLEWLGRPAKGVPQQPTPPLRVSISKKLRAVVEDKYNRAGVEKGKYVVIHGIESDSVANMKSRGDDDCLLPLELWAEIAKEISSGGNGLRPLFVMPHEKHREEIEEIVGEETAYLFITTPGQLTCLINDSAGVVATNTAAVQLANARDKPCVALFSSKAKARLFLPYAEERKSCTVVASATGKLAGIDIEAVKKAVKDLEPAPSFALAQT

SEQ ID NO: 10349 - protein, 464 aa, Hordeum vulgare
MPTPMAARPTSTMATKLPAPSATPRQCHLLPGRRVAGLARASSKKRNPWLDPFDDGPDEEFDYTGVYSGGKQEEDPRPPEDAENPYGFLRFPMGYMPELDSLASKVRGDVRRVCCVVSGGVYENVLFFPVVQMLKDRYPGVLVDVVASARGKQVYEMCKNVRYANVYDPDDEWPEPAEYTHQLGVMKNRYYDMVLSTKLAGTGHALFLFMSSAREKVGYVYPNVNGAGAGLFLTEMFKPATTNLADGGYNMYQDMLEWLGRPAKGVPQQPIPPLRVSISKKLRAVVEDKYNRAGVEKGKYVVIHGIESDSVANMKSRGDDDCLLPLELWAEIAKEISSGGNGLRPLFVMPHERHREEIEEIVGEETAYLFITTPGQLTCLINDSAGVVATNTAAVQLANARDKPCVALFSSKEKARLFLPYVEERKSCTVVASATGKLAGIDIEAVKKAVKDLEPAPSFALAQT

SEQ ID NO: 10350 - protein, 466 aa, Secale cereale
MPTPMATRPASTMAAKLPAPSTPRQCYLLPGRRAGLARGAPSASSKKRNPWLDPFDDGPDEEFDYTGVYSGGKQEEDPRPPEDAENPYGFLRFPMGYMPELDSLASKVRGDVRRVCCVVSGGVYENVLFFPVVQMLKDRYPGVLVDVVASARGKQVYEMCKNVRYANVYDPDDEWPEPAEYTHQLGVMKNRYYDMVLSTKLAGTGHALFLFMSSAREKVGYVYPNVNGAGAGLFLTEMFKPATTNLADGGYNMYQDMLEWLGRPAKGVPQQPIPPLRVSISKKLRAVVEDKYNRAGVEKGKYVVIHGIESDSVANMTSRGDDDCLLPLELWAEIANEISSGGNGLRPLFVMPHERHREEIEEIVGEETAYLFITTPGQLTCLINDSAGVVATNTAAVQLANARDKPCVALFSSKGKARLFLPYVEEKKSCTVVASATGKLAGIDIEAVKKAVTDLEPAPSFALAQT

SEQ ID NO: 10351 - protein, 466 aa, Triticum aestivum
MPTPMATRPTSTMAAKLPAPSTPRQCYLLPGRRAGLARGAPSASSKKRNPWLDPFDDGPDEEFDYTGVYSGGKQEEDPRPPEDAENPYGFLRFPTGYMPELDSLASKVRGDVRRVCCVVSGGVYENVLFLPVVQMLKDRYPGVLVDVVASARGKQVYEMCKNVRYANVYDPDDEWPEPAEYTHQLGVMKNRYYDMVLSTKLAGTGHALFLFMSSAREKVGYVYPNVNGAGAGLFLTEMFKPATTNLADGGYNMYQDMLEWLGRPAKGVPQQPTPLLRVSISKKLRAVVEDKYNRAGVEKGKYVVIHGIESDSVANMKSRGDDDCLLPLELWAEIAKEISSGGNGLRPLFVMPHEKHREEIEEIVGEETAYLFITTPGQLTCLINDSAGVVATNTAAVQLANARDKPCVALFSSKAKARLFLPYAEERKSCTVVASATGKLAGIDIEAVKKAVKDLEPAPSFALAQT

SEQ ID NO: 10352 - protein, 464 aa, Oryza sativa
MSTSMATPAKLPSPPSLPIARQCCCHLLQLGRRGGAGVARASAKKKNPWLDPFDDGPDDEFDYRGAFSGGKQEEDPRPPEDPANPYGFLRFPAGYNPELDSLASKVRRDVRRACCVVSGGVYENVLFFPVVQLLRDRYPGVVVDVVASARGKQVYEMCKNVRYADVYDPDDDWPEPAEYTHQLGVLKNRYYDLIISTKLAGIGHALFLFMSSARDKVGYVYPNVNSAGAGLFLTEMFRPPTTNLADSGYNMYQDMLEWIGRPAKGVPEHPVPPLRVSISKKLRAFVEDKYSRAGVEKGKFVVVHGIASDSFANMRSRGDDDCLLPLEHWAEIAKEISSEDNGLKPLFVIPHQKHREEVEETVGKDTNILFITTPGQLTCLINDSVGVVATNTAAVQLANARDKPCVALFSSKEKARLFLPYLEEKKGCTVVASETGKLIDIDVEAVKKAVKEFKAAPSVALAQT

SEQ ID NO: 10353 - protein, 465 aa, Sorghum bicolor
MSTSMATTPTTARAMAPARPPAPRQCCRYLVLPSTGHRRSIAAWSAKKKNPWLDPFDDGPDEEFDYQGMFSGGKQEEDPRPPEDPANPYGFLRFPQGYNPELDSLASKVRGDVRRACCVVSGGVYENVLFFPVVQMLKDRYPGVLVDVVASARGKQVYEMCKNVRYANVYDPDDDWPEPTEYTHMLGVLKNRYYDLIVSTRLAGLGHALFLFMSSARDKVGYVYPNVNSVGAGLFLDEMFKPPTNNLSDGGYHMYKDMLEWIGRPAKDVPQQPTPPLRVSISKKLRAYVEDKYSRAGVEKGKYVVIHGIASDSVANMKSRGDDDCLLPLEHWAQIAKEISSGDKGLKPLFVIPHEKHRDEIEEEVGEDANILFITTPGQLTCLINDSAGVVATNTSAVQLANARDKACVALFSSAEKAKLFLPYVEDKSSCTVISSATGKLIDIDINAVKNTVKDFEPAPSFALA

SEQ ID NO: 10354 - protein, 461 aa, Zea mays
MSTSMATTAPAKPPAPPRQCCRYLLLPSTGHRRSVAAWSAKKKNPWLDPFDDGPDEEFDYQGMFSGGKQEEDPRPPEDPENPYGFLRFPQGYNPELDSLASKVRGDVRRACCVVSGGVYENVLFFPVVQMLKDRYPGVLVDVVASARGKQVYEMCKNVRYANVYDPDDDWPEPAEYTHMLGVLKNRYYDLIISTRLAGIGHALFLFMSSARDKVGYVYPNVNSVGAGLFLNEMFKAPTNNLADGGYHMYKDMLEWIGRPAKNVPQQPTQPLRVSISKKLRAYVEDKYSRAGVEKGKYVVIHGIASDSVANMKSRGDDDCLLPLGHWAQIAKEISSGDRGLKPLFVIPHEKHRDEIEEEVGDDTSILFITTPGQLTCLINDSAGVVATNTAAVQLANARDKPCVALFSSAEKARLFLPYVEGKSSCTVISSATGNLIDIDLNAVKNVVKDLEPAPSFALAQK

SEQ ID NO: 10355 - protein, 466 aa, Zea mays
MSTSTATTTRAMAPAKPPARRHCCSYLLLLLPSTGHRRSVAAWSAKKKNPWLDPFDDGPDEEFDYQGMFSGGKQEEDPRPPEDPANPYGFLRFPQGYNPELDSLASKVRGDVRRACCVVSGGVYENVLFLPVVQMLKDRYPGVLVDVVASPRGKQVYEMCKNVRYANVYDPDDDWPEPAEYTHMLGVLKNRYYDLIVSTRLAGIGHALFLFMSSARDKVGYVYPNVNSVGAGLFLNEMFKAPTNNLADGGYHMYKDMLEWIGRPAKNVPRQPTQPLRVSISKKLRAYVEDKYSRAGVEKGKYVVVHGIASDSVASMTSRGDDDCLLPLEHWAQIAKEISSGDKGLKPLFVIPHDKHREEVEEEVGDDTNILFITTPGQLTCLINDSAGVVATNTAAVQLANARDKPCVALFSSAEKARLFLPYVEDKSSCTVISSMTGKLIDIDINAVKNAVKDLEPAPSFALAQK

SEQ ID NO: 10356 - protein, 210 aa, Panicum virgatum
  misc_feature (61)..(61): Xaa can be any naturally occurring amino acid
  misc_feature (65)..(65): Xaa can be any naturally occurring amino acid
  misc_feature (143)..(143): Xaa can be any naturally occurring amino acid
MSALALCEGAAKSPCWSECSGSRLLFPTSRVRRGPISCRREKPGTFCLLTASPSLRTNSRXMQWXVKTMSDDSSDQSGNNTRLFSAIQSFWNKFSAKLNKARRGLPMKILFFLIGFYCATAFATVIGQTGDWDILSAGLAVAXVEGIGALMYRASFAFLGRIRNMITIFNYWKAGLTLGLFLDSFKYEVDELLESCNPFNFEINIFAGLW

SEQ ID NO: 10357 - protein, 212 aa, Zea mays
MSTLPLCDGTANSPCWSECSGSRLAAARRVGREAAVSCRWEKPGTLCLLRAKSPSLRRHSRKVQWAIRTMSDDSGDQSGNSTRLFSAIRSFWNQLSAKLKKARRGLPVKILFFLIGFYCATAFATVIGQTGDWDILSAGLAVAIVEVIGALMYRASFAFLGRIGNMITVFNYWKAGLTLGLFLDSFKYEVDEFLESCNPFNFQINIFTGFCW

SEQ ID NO: 10358 - protein, 204 aa, Sorghum bicolor
MELPTRRAGRSAPDRGFAAAPRVGRGAAVSCCWEKPGTLCLLRAKSPSLPRHSRKVEWAIRTMSDDSGDQSSNSTRLFSAIRSFWNKLSAKLKKARKGLPVKILFFLIGFYCATAFATVIGQTGDWDILSAGLAVAVVEVIGALMYRASFALLGRIRNMITIFNYWKAGLTLGLFLDSFKYEVDEFLESCNPFNFQINIFTGLW

SEQ ID NO: 10359 - protein, 356 aa, Setaria italica
MATIAAAAARCNSPARRQLLTRRCLPFSVSFSSATPPAAAAGFGWADALRVAGDGGRGDESDLSGYFRKVDTCNRGMDKRGEFVKFLVEDQVVGYIHKGFVEHLRDFHDVFTIVSGNNGSNTLENVSLRSSLRTPEERTNAIGDVIKNLGELIPGIRNELYPVTSSYGMPVYFSLERAAAPYFGIKAYGVHMNGYVEKDGQKFLWIGKRSDVKQTYPGMLDHLVAGGLPYGISCKENIIKECEEEAGIPRSVSTNATSVGAISYMDIEGFRYKRDVLFCYDLKLLADFVPNNEDGEVDSFRLIPVPHAANIIRRTEFFKPNCNLVIIDFLFRHGYINPDSRGYLNLLQSLRSGDCS

SEQ ID NO: 10360 - protein, 356 aa, Panicum virgatum
MATIAAVAAARCSPPTRRQLLTRRRLPFSVSFSSVAPHAAAAGFGWADALRVAGDGGRGDESDLSGYFRKVDICNRGMDKKGEFVKFLVEDQVVGYVHKGFVKHLRDFHDVFTISGDNSNNTLENVSLQSSLRTPEDRTHAIGEVIKSLGEMIPGIRNELYPVTSSYGMPVYFSLERAAAPYFSIKAYGVHMNGYVEKDGQKFLWIGKRSDVKQTYPGMLDHLVAGGLPYGISCKENIIKECEEEAGIPRSISTNAISVGAVSYMDIEGFRYKRDVLFCYDLKLPEDFVPNNEDGEVDSFRLIPVPHAANIIRRTEFFKPNCNLVIIDFLFRHGYIHPDSRGYLNLLQSLRSGDCS

SEQ ID NO: 10361 - protein, 365 aa, Triticum aestivum
MVAIATSFSAAAAVAVARRSSPAHLQLVARRRLPFCTAASSSSAPPAAAAGFGWADALRVASEFGVGDESDLSGYFRKVDICNRGMGNKGEFVEFMVEDQVVGYIHKGFTEHLRDFPDVFTIVSGNNGKNSVEHVTLHSSLRTPKDRTIAIGDVIKGLGELIPGIRNELYPVTSSYGMPVYFSLERAAAPYFGIKVYGVHMNGYIEKHGEKSLWIGKRSDVKQTYPGMLDHLVAGGLPYGISCKENVIKECEEEAGIPRSMSTNATSVGAVSYMDINGFRYKRDVLFCYDLRLPLDFVPNNEDGEVDSFRLIPVPHAANIIRRTDFFKSNCNLVIIDFLFRHGYINPDCNGYLKLLTSLRSGDCS

SEQ ID NO: 10362 - protein, 365 aa, Secale cereale
MVAIAASFSAAAAVAVARRSSPAHLKLAARRRLPFCTAASSSSAPPAAAAGFGWADALRVASELGVGDESDLSGYSRKVDICNRGMGNKGEFVEFMVEDQVVGYIHKGFTEHLRDFHDVFTIVSGNNGKNSVEHVTLHSSLRTPEDRTIAIGDVIKGLGELIPGIRNELYPVTSSYGMPVYFSLERAAAPYFGIKVYGIHMNGYVEKHGEKSLWIGKRSDVKQTYPGMLDHLVAGGLPHGISCKENTIKECEEEAGIPRSMSTNATSVGAVSYMDIDGFRYKRDVLFCYDLRLPVDFVPNNEDGEVDSFRLIPVPHAANIIRRTDFFKPNCTLVIIDFLFRHGYINPDCNGYLKLLTSLRSGDCS

SEQ ID NO: 10363 - protein, 364 aa, Leymus cinereus x Leymus triticoides
MVTIATSFSAAAAVVARRSSPAHLQFVARRRLPFCTAASSFSAPPASVAGFGWADALRVASEFGVGDESDLSGYSRKVDICNRGMGNKGEFVEFMVEDQVVGYIHMGFTEHLRDFHDVFTIVTGNTGKNSVEHVTLHSSLRTPEDRTIAIGDVIKGLGELIPGIRNELYPVTSSYGMPVYFSLERAAAPYFGIKAYGVHMNGYIEKHGEKSLWIGKRSDVKQTYPGMLDHLVAGGLPYGISCKENIIKECEEEAGIPRSMSINTTSVGAVSYMDINGFRYKRDVLFCYDLRLPVDFVPNNEDGEVDSFRLIPVPHAANIIRRTDFFKPNCNLVIIDFLFRHGYINPDCNGYLKLLTSLRSGDCS

SEQ ID NO: 10364 - protein, 261 aa, Sorghum bicolor
MPPAAATLLRRAPAVPFTARRTAVSRSGMARRLVTASAGAGGRAPAYGGLLLDAGGTLLQVAQPVAETYASIGRRYGVMKPEKRIMEGFKRAFSAPWPKTLRYQGDGRPFWRIVVAEATDCTDDDYFEEVYQYYAHGDAWRLPVGADTALRELKDAGVKLAVVSNFDTRLRKLLKDLNVSDMFDAIVVSSEVGYEKPAPEIFKIALDNIGVEASKAVHVGDDEAADKAGANAIGLECWLWGDDVKTFSEIQDRILTTDDPQ

SEQ ID NO: 10365 - protein, 260 aa, Setaria italica
MPPATAAAARCPLLRRAPAALRGALSRSGMARRLVAASAGGGGRAPAYGGLLLDAGGTLLQVARPVAETYASIGRRYGVTKPEKGIMEGFKRAFSAPWPKTLRYQGDGRPFWRIVVAEATNCTDDDYFEEVYQYYAHGDAWCLPDGADTILRELKDAGVKLAVVSNFDTRLRKLLKDLNVSDMFDAIVVSSEVGYEKPAPEIFKIALDQIGVDASKAVHVGDDETADKAGANGIGLECWLWGADLKTFSEIRYRILTDDQ

SEQ ID NO: 10366 - protein, 457 aa, Sorghum bicolor
MASSCIPAGGIRLPDLEMVKAAPPPAPPRPAHSAAASSTLSEASSNASAASSSATSSSVAASLSLKRPRTPRKRPSQTYNEAAALLASMYPSVFPVAKGFGGLEAPPPPRLLGLASALADDPSCSDLLPPFPVPGGQAAFLLRDLPPPPPPRPLTPRSPAARGCPSPSAVSSVFSEFRDPAPSPATPDDAAAAPDEPGELDFDDDDGFDADSILCGVDEGAAEGIDGIMGKLSMENNVTSVSSGDSNLPRSKMMHPCLRNLMVLGLSFRHDQSIINQALKRHSVDPEWWMCPAIPVKDITPVPPSVAMAKVTDKKKTKKKSLGTIYEEGTPEFANGDTGALALPETGLGLSLNTDGVLKAWRGRGSVFANGNGPDLPLSSAHVVVVHVKHEDSDLFPKNGTSAVIREGNILKMQHKQKPCTPLPSNKQSRYYRPRVKGRFVSKAYFLQQQQALEKES

SEQ ID NO: 10367 - protein, 443 aa, Zea mays
MASSCIPAGGIRLPDLDMVKTAPPPAPHRPAASSTLSEASHSSPASSSSVASLSLKRPRTRTPRKRPSQTYNEAAALLASMYPSVFPVARGWGAPEAAPPRLLGLASALGDDPSCSDLLPPFPVPGGHAAFLLRDLPPPPPQSPAGVAKSCPSPAAVSSVFSEFRDPAPSPATPDDAAAAPDEPGELHFDVDDGFDADSILCGVDQSAAEGIDGIMGKLSMENSGTSVSSSSVNSNLPISKIHPYLRNLMVLGLSFRHDQNIFNQALKRHSVDHEWWMCPAIPVKDITPAPPPSVAMSKVTDKKTKKSLGTMYEEGVPESVNGDAGTLALPETGLGLSLNTDGVLKAWCGRGSVFADSNGSDLPLSSAHVVVKHEDSDSDIFPKNGISAVIREGNILKMQRKQKPCAPLPSNKQSRYYRPRVKGRFVSKAYFLQQQQVLEKES

SEQ ID NO: 10368 - protein, 200 aa, Sorghum bicolor
MAASNGGGGGPGPGPISAEAEAAFGEAIRLVFGRWTALQMAVENQWGGRDSRSKADQFGESILFWFCRTKGPHYFEDLVDMMYDTISESFNSDFEDNSVEEVAEQLLIIHEECLQNNYSSIEKLRNSHVQGNAVSQSRQIVADDDDDSDSSDDGDDTSMMEDQEAPPEEMAVDRPRPPRPTPDADGWTVVPPRRGGRNRN

SEQ ID NO: 10369 - protein, 478 aa, Sorghum bicolor
MPRTTVVESPGCPPLRALTTDIIGLVKVVEAHTKPAGAAKVVETWGDPDASRAIVAASLADRAADPVLAVARKNGVVELLNPLNGDALAAVKTVGPSPNDGGAEGDPLAALHLFTRQASDSILGTFLACTEQGKASIRSITKENAASGSDVGPSATWDVCSGANVQFCSVDHGESYAMFGGKGIEVNLWDITSCSKIWSAKSPRANSLGIFTRPWFTAGTFLCKDDHRKIVACTNDHQVRLYDTALQRRPAISVDFRESPIKAVAADPNGHDVYIGTGTGDLASFDMRTGKLLGCYIGKCSGSIRSIVRHPELPLIASCGLDSYLRIWDTNTRQLLSAVFLKQHLTTVVLDSHFSLEEPEEIKSKQLEFSVEAEAEVRKEKKQKSKTTEDETEAQVRKEKKKKKSETIEEDEEQVGVVDHSNINGEIYARKEKKKKKSRAIEQDEEPDSDGEMCSPNRRKSGERSKCLKKKSKKQLVA

SEQ ID NO: 10370 - protein, 461 aa, Zea mays
MPRTTVVESSGCPPLRALTTDILGLVKVVEAHARPAGAAKVVETWGAPDASRAIVAASLADRAADPVLAVARRNGVVELLNPLNGSALAAVKTAGSAPNDSGAEGDPLAALHLFARQTSDSILGTFLACTEKGKASIRSITKENADSGSDVGPSATWDVCNGANVQFCSVDHGESYVIFGGKGIEVNLWDITSSSKTWSAKSPRANSLGIFTRPWFTAGTFLCKNDHRKIVACTNNHQVRLYDTALQRRPAVSVDFRESPIKAVAADPNGHDVYIGTGTGDLASFDMRTGKLLGCYIGKCSGSIRSIVRHPELPLIASCGLDSYLRIWDTNTRQLLSAVFLKQHLTTVVLDSHFSVEEPGEMKFKQLESLVEAEAEVRKEKKKKKSRPTEEDEEQVGVVDHSDNNGEMYARKEKKKKKKKKSRTIERDEEPDNDGEMCSPKRRKSVERSKCLKKSKKQQVA

SEQ ID NO: 10371 - protein, 500 aa, Saccharum officinarum
MPRTTVVESPGCPPLRALTTDILGLVKVVEAHAKPAGAAKVVETWGAPDASRAIVAASLADRAADPVLAVARKNGVVELLNPLNGDALAAVKTVGPAPNDGGAEGDPLAALHLFTRQASDSILGTFLACTEQGKASMRSITKENAASGSDVGPSATWDVCSGANVQFCSVDHGESYAMFGGKGIEVNLWDITSCSKTWSAKSPRANSLGIFTRPWFTAGTFLCKDDHRKIVACTNDHQVRLYDTALQRRPAISVDFRESPIKAVAADPNGHDVYIGTGTGDLASFDMRTGKLLGCYIGKCSGSIRSIIRHPELPLIASCGLDSYLRIWDTNTRQLLSAVFLKQHLTTVVLDSHFSVEEPGETKSKQLEPSVEAEAEVRKEKKKKSKTTEDETEAQVRKEKKKKKSKTIEEDEEQVGVVDHSDINGEIYARKEKKKRRVELLNRTSQAVTVKCAVPKRRKSGERSIRLKKKSKETTGRLERGIFISLPCLLLDFAKYTNLC

SEQ ID NO: 10372 - protein, 237 aa, Sorghum bicolor
MATYLNAPPAATTMAASYCHAFSGGSLRLLRPSRPTLHVTCQASSSSSQQQPSPSRRSACLGLGLSFACAVLLRPRAVAAATDGGDEEPANNGWWLTEFPLPTPKIVNKEINNAETGTRSFIKNGIYMADIGPSFAAHAYRLRSTAFDLLALEDLLGKDASNYVNKYLRLKSTFMYYDFDKLISAADDKPTFVDLANRLFDSFETLQEAVTAKDDDRISGRYAETKVILQELMAKMA

SEQ ID NO: 10373 - protein, 920 aa, Sorghum bicolor
MTTNTKRAYKLQEFVAHSSNVNCLKIGRKTSRVLVTGGEDHKVNLWAIGKPNSILSLSGHTSAVESVGFDSTEVFVAAGAASGTIKLWDLEEAKIVRTLTGHRSNCMSVDFHPFGEFFASGSLDTNLKIWDIRRKNCIHTYKGHTRGVNAIRFTPDGRWVVSGGEDNIVKLWDLTAGKLLHEFKCHEGQIQCIDFHPHEFLLATGSADKTVKFWDLETFELIGSTGPETTGVRSMTFNPDGRSLLCGLHESLKVFSWEPIRCHDTVDVGWSKLADLNVHEGKLLGCSFNQSCVGIWVVDLTRLEPYATGTSTKLNGHSELKTVSSGTLPLQNDSGSRANIGRSSTLQTSENNLKASSGRLSAQNSDSAPKETKLAPSSGLVPSTPQRAGVSSNNRSVGNSAFQSGGTTLKRSSLRSNSASNVHNFSKADVVPVIVPRTSSGGELATDSRSDAADVAPVLPKVTRRVDPATDSRKESNDVDLVIPKASSRVEIASDSAPVSTFKSGRRLEAAPDSKKESADTTPVVPNPRANARMEMASDSAPALSKANRKLDSGTDSKKESVDAVPAIVPRANSRMEMNSDSRREPSAGRVSPFRIQSRYAELRKLTHAKIDANKVDSGSKITETDDFNCQIFLPRRNGVFQISSEESREDVKCGPADRMGFSNSSEPNASVRSENYVSRMRKPRDNCYIEVSRAGRARSNVSNWEGRDQSPSHEEPTTSSSSLAPTGRPYSSRGSKQASETPIIVSDEDVLSLLMEQHDLFLSSTKSRLTKLQIIHQMWERNDIRGVLSAMERMGDHAVCADMASVLMEKSEIITLDLCTSILPAVTDLLESKIDRHLSVTLELLVKLVRTFGPMIHSTVSSGPCVGVDLEAEQRRERCNLCFIELEKAKNKLPSLTRRKGAVANAAQELALVFQEIMS

SEQ ID NO: 10374 - protein, 921 aa, Setaria italica
MTTNTKRAYKLQEFVAHSSNVNCLKIGRKTSRVLVTGGEDHKVNLWAIGKPNSILSLSGHTSAVESVGFDSTEVFVAAGAASGTIKLWDLEEAKIVRTLTGHRSNCMSVDFHPFGEFFASGSLDTNLKIWDIRRKNCIHTYKGHTRGVNAIRFTPDGRWVVSGGEDNTVKLWDLTAGKLLHEFKCHEGQIQCIDFHPHEFLLATGSADKTVKFWDLETFELIGSTGPETTGVRSMTFNPDGRSLLCGLHESLKVFSWEPIRCHDTVDVGWSRLADLNVHEGKLLGCSFNQSCVGIWVVDLTRLEPYATGTSTKLNGHSELKTVSSGTMPLQNDTGSKANIGRSSVLQNSENNLKASSGRLSVSQNSDSALKETKSTASSGLVPSTPQRAGVGSNNRSFGNSAFASGGTTLKRSSLRSHNASSVSNFSKSDVVPVIVPRTSSGGELATDSRSDAADVAPVLSKATRRVDPATDSRKESTDVEPVVPKASSRMEISSDSAPVVISKSSRRLESGADSKKESADAASVVVPRENTKMEMASDSAPVLSKASRKVDPGTDSKKESADAAPVIPRASSRTEMASDARREPSAGRISPFRIQSRYAELRKLTHAKVDANKVDSRSKNTETDDFNCQIFFPRRNGVFQTISSEETREDIKHGAVDRMAFSNPAELNASVRGENYVSRMRKPRDNCYVEVSRAGRARSSVSNWEGRDQSPSHEEPTTSSSSLAPTGRSYSSRGSNQASETPTIASDEDVLSLLMEQHELFLSSTRSRLTKLQIIHQMWVRNDIRGVLSAMEKMCDHAVSADMASVLMEKSETITLDLCTSILPVVTDLLESKTDRHLGVSLELLVKLVRTFGPMIHSTVSAGPSSVGVDLEAEQRRERCNLCFIELEKVKNKLPFLTRRKGAVANAAQELTLVFQEVMS

SEQ ID NO: 10375 - protein, 931 aa, Zea mays
MATNTKRAYKLRILVDSFPLFRYLFFVEFLVGEEFVAHASNVNCLKIGRKTSRVLVTGGEDHKVNLWAIGKPNSILSLSGHTSAVESVGFDSTEVFVAAGAASGTIKLWDLEEAKIVRTLTGHRSNCMSVDFHPFGEFFASGSLDTNLKIWDIRRKNCIHTYKGHTRGVNAIRFTPDGRWVVSGGEDNIVKLWDLTAGKLLHEFKCHEGQIQCIDFHPHEFLLATGSADKTVKFWDLETFELIGSTGPETTGVRSMTFNPDGRTLLCGLHESLKVFSWEPIRCHDTVDVGWSRLADLNVHEGKLLGCSFNQSCVGIWVVDLTRLESYATGTSTKLNGHSELKTVSSGTMPLQNDSGSRANIGQSSVLQSSENNLKASSGRLSVSQNSDSAPKETKSTPCIGLVPSTPQRAGFSSNNRSVGNSTFQSGGTTTTLKRSSLRSNSASNVHNFSKADIVPVIVPRASSGGELVTGSRSDAGDVAPVLPKVTRRADPSSDSRKESNDVEPVIPRASSTMEIASDSAPISTSKSGRRLEAAPDSKKESADTAPAVPNPRANARMEMASDSAPALLKTNKKLDSGTDSKKESADAVPVILISDSRREPSAGRVSPFRIQSRYAELRKLAHAKIDRGSKTTGTDDFNCQIFLPRKNGVFQTISSEETRKDVKCGPVDRTEFSNSSEPNASVRSENYVSRMRKPRDNCYIEVSRKGRARSSVCNWEGRDQSPSHEEPMTASSSLAPTGRPNSSRGSSQASETPIIANDEDVISLFMEQHELFLSSTKSRLTKLQIIHQMWERNDIRGVLSAMERMGDHAVCADMASVLMEKSDVITLDLCTSILPAATDLLESKIDRHLGVALELLVKLVRTFGPMIHSTVSSGPCVGVDLEAEQRRERCNLCFIELENAKNKLPSLTRRKGAVANAAQELALVFQEIMS

SEQ ID NO: 10376 - protein, 377 aa, Panicum virgatum
MLLMWHLFFLRQPEGLILLLSLEKKVLMWNLLFLEQAQEWKYPLIQHLLLFPSQAEGWSLALIQKKESPDAAPVVPRSNTKMEMAFESAPILSKANRKVDSGTDSKKESADATPVIAPRTSSRTEMSSDSRREPSAGRVSPFRIQSRYAELRKLTHAKVDSGIKNTETDDFNCQIFLPRRNGVFQTISSEETREDMKHGAVDRMPFSNSAEPSSSVRSENYVSRMRKPRDNCYVEVSRAGRARSNVSNWEGRDQSPSHEEPTTSSSSLAPTGRSYLSRGSNQASETPTIASDEDVLSLLMEQHELFLSSTRSRLTKLQIIHQMWVRNDIRGVLSAMEKMCDHAVSTLATLSYASNNHHLADYIVSVNCRSLLIWQVF

SEQ ID NO: 10377 - protein, 447 aa, Sorghum bicolor
MVTADPDGSGGAPDVSELFCHYNSLYFRDSLGSCAVSWAEDPLPNSDVSICDYYPGGGGCIILLSKSLCGSHNGSDLKNALLHEMIHAYICIKYNNSNHSDHGAKFQKLVNTINLSSVADPHRPVDGYSITLLHEIHKKYYHYKCQSCADFIKSTNMRGPSGDDCIERKGGDDPCHNSNCHWHRHKQRCSGNYCRVQESSPGGLELKCSEAVEVFNEGKVEEPACTSWHPTHTSNKSRRSNRNEQEDASTEFLHVADNAVGCSGLDSSSKDGSNKKIKFSKDVSSDLRRTETVQETPKRPRAAVLDNQECSRRKKRKQSKRYGSYSVIIEWLNYYCLSESDEDEVPLINKRTERRRRQRFHEMSLARESSDVVEFGSSNSHMVGSCALAPKDNTKLEIVPASQPEERSCSSHPVASNGVAGNQTGREPMSSPMDSLIRGEIVDISDG

SEQ ID NO: 10378 - protein, 795 aa, Sorghum bicolor
MPNVMAAAPAGCLPRGVIPPARSSRGRASLPGVARAYAERRLVAENTSLPNKHVQHKEELETRIRNQLRRPQLPPSLYDTAWVSMVPMRGSHHTPCFPQCVEWILQNQQDDGSWGVSQSGSEVNKDVLLSTLACVLALKRWNVGRENMWRGLHFIGRNFYVAMDEQVAAPVGFNITFPGLLSLAIDMGLEIPIRQTDVCGILHLREMELKRQAVDSSYGRKTYMAYIAEGLGSMVDWDEVMKFQRKNGSLFSSPSTTAVALIHKYNDPALQYLNLLVSEFGSSDALERMGISQHFVSEIESILDMAYSCWLQKDEEIMMDKATCAMAFRLLRMNGYDVSSDVLSHVAGPSTFHDSLQGYLNDTKSLLELYKASKVSLSENDLVLDGIGFWSGNLLKDKLCSSRVKKDLIFGEMEYAVKFPFYATLERLEHKRNIENFDAWGPLMLTTKSSSFCIDQEFVALAVEDFSFSQYVYQDELRHLDSWVKENKLDQLQFARQKLTYCYLSAAATIFSSELSDARISWAENGVLTTVVDDFFDVGGSKEELENLIALVEKWHAHHTVGFYSEQVKIVFSAIYTTVNHLGVIASAAQGRDVTNHLVEIWLDLLRSMMVETEWQRSQYVPTVEEYMTNAVVSFALGPIVLPALYFVGQEVLEHAVKDEEYDELFRLMSTCGRLLNDSQSFEREGNQGKLNSVSLLVRHSGGSMSIEAAKKALQKSIDVSRRDLLRLVLRKESVVPRPCKELFWKMCKILHLFYFQTDGFSSPKEMVSAVNAVINEPLTVQNTTSSFLSSSSGK

SEQ ID NO: 10379 - protein, 801 aa, Setaria italica
MPNITAAAPASCSPCGAILASRAPRRGVVKAYPEKRLVAENVRVQNMHRKELETRIRNQLQRPELPPSSYDTAWVSMVPLRGSHQSPCFPQCVEWILQNQEDDGSWGVNQFDSSVNKDVLLSTLACVIALKRWNVGRENIRRGLHFIGRNFSVAMDEQTTAPIGFNITFAGMLRLAIDMGLEFPIRQTDVHGILHLREMELKRQAVDSSYGRKAYMAYIAEGLGNMLDWDEIMKFQRKNGSLFSCPSTTAAALIHKYNDQALQYLNLLVSEFGSAVPAVYPSKIHWQLLMVDALEKMGISQRFVSEIKSILDMTFSRWLQKDEEIMMDIATCAMAFRLLRMNGYDVSSDELSHVAEASTFCDSLQGYLNDTKSLLELYKASKVSLSENDLILDSIGSWSGNLLNDKLYSNRAQKTPIFGEMEYVVKFPFYATLERLEHKRNIEHFDAWGSLMVSTKCSSFRVNQEFLALAVEDFSFSQSVYQDELQHLDSWVKENKLDQLQFARQKLTYCYLSAAATIFPSELSDARISWAKNGVLTTVVDDFFDVGGSKEELENLIALVEKWHEHHADKFYSEQVKIVFSAIYATTNQLGAKASAAQGRDVTKHLAKIWLDLLRSMMTEAEWQRSQHVTTVEEYMTNAVVSFALGPIVLPALYFVGEELSEHAVKDQEYNKLFRLMSTCGRLLNDIQGFEREGSEGKLNSVSLLVHSGSSVSIEAAKKVIQKSIDTSRRDLLRLVLRKESIVPRPCKELFWKMCKILHLFYFQTDGFSSPKEMVSAVNAVINEPLKIQLDDSSLNILSEK

SEQ ID NO: 10380 - protein, 717 aa, Sorghum bicolor
MRALASPTASFLPGIPSPSPRARGALRSAPAALSRAPSGRSVAASAAAATGDHWGADHQHYHGGRAGASEAGSPASARGVKCDVDVVSWRERRVLASVPVAADVDTLWQVITDYERLADFIPNLVQSGTIPCPHEGRIWLEQRGLQQALYWHIEARVVLDLQEIHDSINGRELHFSMVDGDFKKFEGKWSIRSGPRSSSAVLLYEVNVIPRFNFPAIFLEKIIRSDLPVNLGALACRAEKIYLENQSCGSRKFSVEDLKPSSTSSQLDNFRSRTVDTSSSKFKEAPPTSGVNSVLPSPASELISKWGVYGNVCRIDRPCVVDEIHLRRFDGMLEHEGAHRCVFASITVKAPVREVWNVLTAYENLPEFVPNLAISRIVLRDNNKVRIMQEGCKGLLYMVLHARVVMDLREKFEQEIRFEQVEGDFYSFKGKWRLEQLGDQHTLLKYMVETKMHRDTFLSESILEEVIYEDLPSNLCAIRDYIEKAGAKGSNSTAHSDVSIDPDAYHAESRQSEQASVSCSSSTMKQRPKVPGLQKDIEVLKSELENFIAEYGQYGFMPKRKHLRSHGRVDIEKAITRMGGFRKIASIMNLSLSYKNRKPRGYWDNLENLQEEISRFQKSWGMDPSYMPSRKSFERAGRYDIARALEKWGGVQEVSRLLSLKLRRPRRQGDLDDESRSESPSEMTKKHGVKPDKGNVSPDAQKWLLKLKDLDVNWVEY

SEQ ID NO: 10381 - protein, 717 aa, Setaria italica
MRALSSPAASFLPGILNPSANPNPRAPLRSAVAALSRGPCPSGRSVAAAAAAATGDHWGADHYHGGGHASSQEAAARAAHGVKCDVDVVSWRERRVLGSVAVAADVDTLWQVITDYERLADFIPNLVQSGRIPCPHEGRIWLEQRGLQQALYWHIEARVVLDLQEVPDSINGRELHFSMVDGDFKKFEGKWSIRSGPRSSSAILLYEVNVIPRFNFPAIFLERIIRSDLPVNLRALACRAEKIYLENQRCGFSAVDSKPSSTSSQLKFHSSTIDTTSSKFKEAPPTSGVGSVLPSPSSELIGKWGVYGNTCRIDRPCVVDEIHLRRFDGLLEHEGAHRCVFASITVKAPVREVWNVLTAYENLPEFVPNLAISRIVLRDNNKVRIMQEGCKGLLYMVLHARVVMDLREKLEEEISFEQVEGDFYSFKGKWRFEQLGDQHTLLKYMVETKMHKDTFLSESILEEIIYEDLPSNLCAIRDYIEKAGAEGSNSTTHSAAPTHPDIDHAEDRQSEKESASCSFSSMKQRPKVPGLQKDIEVLKSELENFIAKYGQDGFMPKRKHLRSHGRVDIEKAITRMGGFRKIASTMNLSLSYKNRKPRGYWDNLENLQEEISRFQKSWGMDPSYMPSRKSFERAGRYDIARALEKWGGVQEVSRLLSLELRRPRRQADSDDERQSESPAGSGITKQHGMKPDKANTSLDAHKWLLKLKDLDVNWVEY

SEQ ID NO: 10382 - protein, 251 aa, Sorghum bicolor
MDEDWELLLASPKAAVAAEPYAGGGGGGGEDDAGAIKHDYFDLGSDAKYPRRASLSKGNDEVDEEEGVDEGLLGASDNSSWVEPDPDDLLFPGRDRAALWSDSSSDGERPEVEATDPVERAREEDGVTVAAAADGGEGAVAKGGGGPVPWWKLSLDALRVWALRAARSAWSVPFAVALLGFAVLGRRLYRMRRQSKAVARVRLVLDEKKVSQFKGQSSRLNESMTMVRRTPIIKPMLPANGVTPWPVLGHL

SEQ ID NO: 10383 - protein, 240 aa, Panicum virgatum
MDEDWELLLASPKAAAAEPYAGGGGEDDAGAIKHDYFDLGSDAKYPRRASLSKEDEEEGEAEGLLAGSDNASWVEPDPDDLLFPGRDRAALWSDSSSDGERPEVEVTEPVERTRAEAGAAAEEEGAEGAVAKGGGPVRWWKLSLDALRVWALRAARSAWSVPFAVALLGFAVLGRRLYRMRRQSKAVGRVRLVLDEKKASQFRGQASRLNEPTTMLRRAPIIKPMLPANGVTPWPVLGHL

SEQ ID NO: 10384 - protein, 272 aa, Saccharum officinarum
PSRSSLPSESRSRTLAGLREMDEDWELLLASPKGAGVAVAAAEPYAGGGGRGGEDDAGAIKHDYFDLGSDAKYPRRAPLLKADEEKEEVVEEGLLGASDNASWVEPDPDDLLFPGRDRAALWSDSSSDGERPDVEATDPVGRATEEAGVTAAAAADAGEGTVAKGGGPVPWWKLPLDALRVWALRAARSAWSVPFAVALLGFAVLGRRLYRMRRQSKAVARVRLVLDEKKVSQFKGQSSRLNESMTMVRRTPIIKPMLPANGVTPWPVLGHL

SEQ ID NO: 10385 - protein, 250 aa, Setaria italica
MDEDWELLLASPKAAAAAEPYAGGGGEDDAGAIKHDYFDLGSDAKYPRRTSLSKEDEEEEEEEVEGLLAASDNASWVEPDPDDLLFPGRDRAALWSDSSSDGERPEVEVTEPVERARAEAGAAAAAAAAEAEAEGAEGAVAKGGGPEPWWKLPLDALRVWALRAARSAWSVPFAVALLGFAVLGRRLYRMRRQSKAVGRVRLVLDEKKASQFKGQASRLKESTAMLRRAPIIKPMLPANAVTPWPVLGHL

SEQ ID NO: 10386 - protein, 257 aa, Cenchrus ciliaris
  misc_feature (233)..(238): Xaa can be any naturally occurring amino acid
  misc_feature (244)..(251): Xaa can be any naturally occurring amino acid
LPHPTRHTTLILPLPFPFSSSLPNPKLTPPLSAPDSQTLSGHLRKMDEDWELLLASPKAVAAAAEPYAGGGGEDDAGAIKHDYFDLGSDAKYPRRASLSKEDEAEEEVEGLLAASDSASWVEPDPDDLLFPGRDRAALWSDSSSDGERPEVEVTEPVERARAEAGAASAAAAEGGEGAVAKGGAPVRWWKLPLDALRVWALRAARSAWSIPFAVALLGFAVLGRRLYRMRRQXXXXXXVRLVLXXXXXXXXRVKHHV

SEQ ID NO: 10387 - protein, 345 aa, Sorghum bicolor
MDEASTSASGAATRRAFPPARSGVFYRFTQQNLPAWKPAMTPGCLIAMFLIIGIIFVPFGLLCLQSSNHVAEIIHRYDVDCVPNAYRGNRQAYIKDSSILKNCTLQAKVLEHMRAPIYVYYELENFYQNHRRYIKSRSDKQLRFGAKYTAESCSPVQWDNNGSPIVPCGLIAWSLFNDTYDFTRGSKEIKVNRKNISWKSDREHKFGRDVFPSNFQNGTLIGGGKLDPTVPLSEQEDLIVWMRTSALPKFRKLYGVIEDDLHADETITILIGNNYNTYTFGGKKSIVLSTASWLGGKNNFLGHAYIVTGSLSIFISILFALIHVKYPRPQGDPNCLSWNRKNSNS

SEQ ID NO: 10388 - protein, 345 aa, Setaria italica
MDEASTSASGGATRRAFPPARSGVYYRFTQQNLPAWKPAMTPGCLIATFLVIGIIFVPFGLFCLQTSNHVAEIIRRYDVDCVPNAYRGNKQAYIKDSSISKNCSLEVKVLDHIRAPIYVYYELENFYQNHRRYVKSRSDKQLRFGAKYTAESCSPVQLDDNGFPIVPCGLIAWSLFNDTYDFTHGSKEIKINRKNISWKSDREHKFGKNVFPSNFQNGSFIGGGKLDPTVPLREQEDLIVWMRTAALPKFRKLYGVIEEDLQVDETISILIRNNYNTYTFGGKKSIVLSTATWLGGKNDFLGYAYIVTGSLSIFMSILFALIHVKYPRPQGDLNCLSLNRKNSNS

SEQ ID NO: 10389 - protein, 345 aa, Pennisetum glaucum
MDEASTSASGGVTRRAFPPARSGVYYRFTQQNLPAWKPAMTPGCLIATFLVIGIIFVPFGLFCLQTSNHAAEIIRRYDVVCVPHAYRGNKQAYIKDSSISKNCSLEVKVLDHMRAPIYVYYELENFYQNHRRYVKSRSDKQLRFGAKYTAESCSPVQLDDNGFPIVPCGLIAWSLFNDTYDFTHGSKEIKINRKNISWKSDREHKFGKNVFPSNFQNGSFIGGGKLDPTVPLSEQEDLIVWMRTAALPKFRKLYGVIEEDLQVDETISILVRNNYNTYTFGGKKSIVLSTATWLGGKNDFLGYAYIVTGSLSIFMSILFALIHVKYPRPQGDLNCLSLNRRNSNS

SEQ ID NO: 10390 - protein, 226 aa, Saccharum officinarum
MGRAPRRPASPAAAAAVPSLLLFAVLFVGRAAAFGDPQGAATTELYKHASFFDRDGDGVVSFAETYGAFRALGFGLGMSGVSAAFINGALGSKCRPQNATSSKLDIYVEDIYKGKHGSDSGSYDAEGRFVPEKFEEIFAKHAKTVPDALTSDEIDQLLEANRQPGDYSGWAGAEAEWKILYSLGKDKDGLLHMDVARSVYDGTLFHRLAPDWKSPEREKLSVIREN

SEQ ID NO: 10391 - protein, 220 aa, Sorghum bicolor
MSRAPRRRASPSAAAAVPWLLLFAVLFVGRATAQGPGATPLSKHASFFDRNGDGVVSFEETYGAFRALGFGFGMSGVSAAFINGALGSKCRPQNATSSKLDIYIEDIYKGKHGSDSGSYDTEGRFVPDKFEAIFANHAKTVPDALTSDEIDQLLQANREPGDYTGWAGAEAEWKILYSLGKNQNGLLHKDVARSVYDGTLFHRLAPNWKPLDKESVIREN

SEQ ID NO: 10392 - protein, 218 aa, Setaria italica
MGGAPRRPAAMAAVPSSLLLFAVLFVGRAAAYGDGATALHRHAAFFDRDGDGVVTLSETYGAFRALGFGFGLSSVSAAFINGALGSKCRPENATSSKLDIYIEDIQNGKHGSDTGSYDTEGRFIPEKFEEIFAKHAKTVPDALTSDEIDQLLQANRQPGDYAGWAGAEAEWKILYSLGKDKDGLLHKDVARSVYDGSLFHRLAPNWNSPDKEKLRREN

SEQ ID NO: 10393 - protein, 736 aa, Sorghum bicolor
MGQDAGFKREGHSGLGAGPETLKTSCCTSEENESRNRRYHQLKGSESNSGQLHLDYIPNFHCKSLPTRSRKTNAEQSVIGKRGSMYQSSSEISRIRKIQEGRRKIDSAFDGDAFLSFDIVDASSRPSTSGAYLHSHQNRRSGAKPSVETARKINRASKDFLDLSFRELPDENFKLDRPRLDSTLLKNDGDDGFLEISLEKEITKGGPCRNAAPVLLSTESGKCTETNNLHKMRGCPSENDCGERGRDSASSSKSTPVKASSFDGTCQSNGVQHHIIENSTKARSSPFKKMLDPIMKSKSLRSPSLMEKGDSNSITGTGSKKNSMSRKSLLGDFSRTEQASNCQPNGQAQRVKSALSPAHLQAVLRLDSKNGVQVFEFCVEGPEESISARNWKTGDELNSIYTFHSGGKRSSAAGRISKDGGLNLPPIVGQVQVSSYLCSEVGKDGTVNNSVVTEFVSYDIAHARRIVEEKTQCTETPQQPLCGVVDKSISGDSPQRINLMEENKIGRNNSDVSTSCPWSEEDLYPHFEIAATVIEIPFSKDKSKEMKNGSSPCTVKVVTPSGLHGSPSDDEASPSPLLDRWRYSGGCDCGGWDMACPIEILGNVYDNNWAESVTTNAKHPMELFVQGSKEELPVLSMKENGRGQFLVDFHGRLSALQAFSVCISLLHCSEASIAISLEKGKQKLYSSSLKLLLEEDVRHLIEAVTAEEKKQQKKKRREKAPPSVLLDPPFSPIGRV

SEQ ID NO: 10394 - protein, 629 aa, Sorghum bicolor
MGQDAGFKREGHSGLGAGPETLKTSCCTSEENESRNRRYHQLKGSESNSGQLHLDYIPNFHCKSLPTRSRKTNAEQSVIGKRGSMYQSSSEISRIRKIQEGRRKIDSAFDGDAFLSFDIVDASSRPSTSGAYLHSHQNRRSGAKPSVETARKINRASKDFLDLSFRELPDENFKLDRPRLDSTLLKNDGDDGFLEISLEKEITKGGPCRNAAPVLLSTESGKCTETNNLHKMRGCPSENDCGERGRDSASSSKSTPVKASSFDGTCQSNGVQHHIIENSTKARSSPFKKMLDPIMKSKSLRSPSLMEKGDSNSITGTGSKKNSMSRKSLLGDFSRTEQASNCQPNGQAQRVKSALSPAHLQAVLRLDSKNGVQVFEFCVEGPEESISARNWKTGDELNSIYTFHSGGKRSSAAGRISKDGGLNLPPIVGQVQVSSYLCSEVGKDGTVNNSVVTEFVSYDIAHARRIVEEKTQCTETPQQPLCGVVDKSISGDSPQRINLMEENKIGRNNSDVSTSCPWSEEDLYPHFEIAATVIEIPFSKDKSKEMKNGSSPCTVKVVTPSGLHGSPSDDEASPSPLLDRWRYSGGCDCGGWDMACPIEILGNVYDNNWAESVTTNAKHPMELFVQVQG

SEQ ID NO: 10395 - protein, 188 aa, Sorghum bicolor
MKHLVLPSPLPLLLHRPTKPHLLHPRRRLVSIRNAASGGSSGEPTPAADTATGTSPPAGATAKPAGVKDRLKARNQSRRVQLDSPPPEVVVVPKRKPAASSSSSSSSPAPKRKERRKEWEEMSVGEKAAELYVGEKGLLFWLNKFAYASIFIMVGAWILFRFVGPSIGLYQLDAPPLPPTAVFGGGSP

SEQ ID NO: 10396 - protein, 183 aa, Saccharum officinarum
  misc_feature (174)..(174): Xaa can be any naturally occurring amino acid
MKHLLLPSPLPLLLHRPSRPHLLHPRRGLVSIRNAASGGSSGEPTPAAETATGTSPPAAATAKPAGVKDRLKARNQARRVQLDSPPPEVVVAPKRKPAASSSSPAPKKKERRKEWEEMSVGEKAAELYVGEKGLLFWLNKFAYASIFIMVGAWILVRFVGPSLGLYQLDAPAVXATGVVGGSS

SEQ ID NO: 10397 - protein, 268 aa, Sorghum bicolor
MGQDVVAHVYDVATAGSDTTVLHINRFFKDGLGLGGIFHTAIQVYGDEEWSFGYCERGTGVFSCPPCKNPMYTYRESIVLGKTNCCILKVNQILRELSWEWPGQSYELLSRNCNHFCNTFCEKLEVPKLPGWVNRFANAGDAALDVAETTAVKLKQAKKEIVTACKAASTFLTGTSSSSSSNAEDMGGSTSSGNSLFEGAWIRSIVGMTIKPSKSLVCVDSSDSDSSESESVSDGDRPNSDDNAEQQAKGATQEPGTKNENNKPQGHS

SEQ ID NO: 10398 - protein, 260 aa, Setaria italica
MGQEVVAHVYDVANAGTDNTVLHINRFFKDAIGLGGIFHTAIQVYGDEEWSFGYCERGTGVFSCPPCKNPMYTYRESIVLGKTNCCILKVNQILRELSWEWPGQSYELLSRNCNHFCNTFCEKLEVPKLPGWVNRFANAGDAALEVAETTAVKLKQAKKEIVTACKVASTFLTGTSSSGSSNVEDTGGSTSTRNPLFEGTWIRSIVGMSMKPPKSLVCVDSSDSECSDTESESDNADQQVKDAKQEQHMESDNNGPRDHS

SEQ ID NO: 10399 - protein, 83 aa, Zea mays
MSSCCGGKCGCGSSCSCGSGCNGCGMYPDVETAATSSVKTTVLAAPTTKASAGGFEAATEGGGCDCNTCKCGTSCGCSCCSCN

SEQ ID NO: 10400 - protein, 470 aa, Zea mays
MAHLITNCSFQTFSSSPNYCRNIGQLQNSKSSNLSLKSCSRRQKKSYVTCASAAVQGQTQTPLTGSQQAYEHSSSKPKKVMVIGGDGYCGWATALHLSNKGYEVAIVDNLVRRAFDNQLGLDSLTPITSIQNRVRRWKSLTAKTIQLFIGDICDFEFLSEAFKSFEPDAAVHFGEQRSAPYSMIDRSRAVYTQHNNVIGTLNVLFAIKEYSEECHLVKLGTMGEYGTPNIDIEEGFITITHNGRTDTLPYPKQASSFYHLSKVHDSHNIAFTCKAWGIRATDLNQGVVYGVRTDETAMHEELSNRFDYDGVFGTALNRFCVQAAVGHPLTVYGKGGQTRGYLDIRDTVQCVELAIANPAKPGEFRVFNQFTEQFSVNELAKLVTAAGAKLGLEVETKSIPNPRVEAEEHYYNAKHTKLIELGLVPHLLSDSLLDSLLNFAIQYKDRVDTAQIMPSVSWKKMGAKPRTVSV

SEQ ID NO: 10401 - protein, 454 aa, Saccharum officinarum
PNYYRCVGQLQNSKSSNLSLKSCSRRQKKSYVTCASAAVQGQTQTPLTGSQQAYEHSSSKPKKVMVIGGDGYCGWATALHLSNKGYEVAIVDNLVRRLFDHQLGLDSLTPITSIQNRVRRWKSLTGKTIQLFIGDICDFEFLSEAFKSFEPDAAVHFGEQRSAPYSMIDRSRAVYTQHNNVIGTLNVLFAMKEYSEECHLVKLGTMGEYGTPNIDIEEGFITITHNGRTDTLPYPKQASSFYHLSKVHDSHNIAFTCKAWGIRATDLNQGVVYGVRTDETAMHEELSNRFDYDGVFGTALNRFCVQAAVGHPLTVYGKGGQTRGYLDIRDTVQCVELAIANPAKPGEFRVFNQFTEQFSVNELAKLVTAAGAKLGLEVQTKSVPNPRVEAEEHYYNAKHTKLIELGLVPHLLSDSLLDSLLNFAIQYKDRVDTAQIMPSVSWKKMGAKPRTVSV

SEQ ID NO: 10402 - protein, 481 aa, Solanum phureja
MAHLLSTTCSLDVSSSNKLHFKSINQCSTPIPTSFNMGISFSPLKKLSLQSKRSAKYVVRASAVSMSQEARTQNDSGSQQTTDGASTRKKVMVIGGDGYCGWATALHLSNKGYEVAIVDNLIRRLFDDQLGLDSLTPISSIHNRIRRWKSLTGKDIQLFVGDICEFEFLAEAFKSFEPDAVVHFGEQRSAPYSMIDRSRAIYTQHNNVIGTLNVLFAIKEFREECHLVKLGTMGEYGTPNIDIEEGYITITHNGRTDTLPYPKQASSFYHLSKVHDSHNIAFTCKAWGIRATDLNQGVVYGVRTDETAMHEELVNRLDYDGVFGTALNRFCVQAAVGHPLTVYGKGGQTRGYLDIRDTVQCVEIAIANPAKPGEFRVFNQFTEQFSVNELAALVTKAGEKLGLEVKAISVPNPRVEAEEHYYNAKHTKLIELGLQPHLLSDSLLDSLLNFAVQYKDRVDTKQIMPSVSWKKIGAKPKTVAA

SEQ ID NO: 10403 - protein, 480 aa, Solanum lycopersicum
MAHLLSTTCSLDVSSSKKLHFKSINQCSTPNPTCFNMGISFSPLKLSLQSKRSAKYVIRASAVSMSQEARTQNDSGSQQTTDGASTRKKVMVIGGDGYCGWATALHLSNKGYEVAIVDNLIRRLFDDQLGLDSLTPISSIHNRIRRWKSLTGKDIQLFVGDICEFEFLAEAFKSFEPDAVVHFGEQRSAPYSMIDRSRAIYTQHNNVIGTLNVLFAIKEFREECHLVKLGTMGEYGTPNIDIEEGYITITHNGRTDTLPYPKQASSFYHLSKVHDSHNIAFTCKAWGIRATDLNQGVVYGVRTDETAMHEELVNRLDYDGVFGTALNRFCVQAAVGHPLTVYGKGGQTRGYLDIRDTVQCVEIAIANPAKPGEFRVFNQFTEQFSVNELAALVTKAGQKLGLEVKAISVPNPRVEAEEHYYNAKHTKLIELGLQPHLLSDSLLDSLLNFAVQYKDRVDTKQIMPSVSWKKIGAKPKTVAA

SEQ ID NO: 10404 - protein, 483 aa, Musa acuminata
MAHSILPCCSINSCLTTKTYLKNNNTCSAVFYNSVPLQTCKYPGTVLRPCKLRPRRQSIIYATATPMSQEIEKSTLTGSPQSSSESSAKSKKVMIIGGDGYCGWATALHLSNKGYEVAIVDNLVRRLFDHQLGIDSLTPISSIQNRVRRWKSVTGKSIQLFIGDICDFEFLSEAFKSFEPDSVVHFGEQRSAPYSMIDRSRAVYTQHNNVIGTLNVLFAIKEFSQECHLVKLGTMGEYGTPNIDIEEGYITITHNGRTDTLPYPKQASSFYHLSKVHDSHNIAFTCKAWGIRATDLNQGVVYGVRTDETDMHEELCNRFDYDGVFGTALNRFCVQAAVGHPLTVYGKGGQTRGYLDIRDTVQCVELAVANPAKPGEFRVFNQFTEQFSVNDLARLVTTAGKKLGLDVQTISVPNPRVEAEEHYYNAKHTKLIELGLRPHLLSESLLDSLLNFAIKFKDQVDPAQIMPTVSWKKIGVKTRTVSV

SEQ ID NO: 10405 - protein, 481 aa, Solanum tuberosum
MAHLLSTTCSLDVSSSNKLHFKSINQCSTPIPTSFNMGISFSPLKKLSLQSKRSAKYVIRASAVSMSQEARTQNDSSSQQTTDGASTRKKVMVIGGDGYCGWATALHLSNKGYEVAIVDNLIRRLFDDQLGLDSLTPISSIHNRIRRWKSLTGKDIQLFVGDICEFEFLAEAFKSFEPDSVVHFGEQRSAPYSMIDRSRAIYTQHNNVIGTLNVLFAIKEFREECHLVKLGTMGEYGTPNIDIEEGYITITHNGRTDTLPYPKQASSFYHLSKVHDSHNIAFTCKAWGIRATDLNQGVVYGVRTDETAMHEELVNRFDYDGVFGTALNRFCVQAAVGHPLTVYGKGGQTRGYLDIRDTVQCVEIAIANPAKPGEFRVFNQFTEQFSVNELAALVTKAGENLGLEVKAISVPNPRVEAEEHYYNAKHTKLIELGLQPHLLSDSLLDSLLNFAVQYKDRVDTKQIMPSVSWKKIGAKPKTVAA

SEQ ID NO: 10406 - protein, 246 aa, Saccharum officinarum
MAGTWVKMEQKGAGPGARSSHAITLVGHTAYAFGGEFTPRVPVDNTMYAFDLTTQTWSALDDATGDVPPPRVGVTMAAVGGTVYTFGGRDLEHKELNELYAFDTATRAWTLLSSGADDGPPHRSYHSMVADAECGRVYVFGGCGDAGRLNDLWAYDVAAGTWEELPSPGEACRPRGGPGLARRRREGVGGVRVLRRGARRRALLRPGDPGVGCGRDHGRQAQSSERVLRGRDREARCGVWRRGGPQ

SEQ ID NO: 10407 - protein, 332 aa, Oryza sativa
MPMAAGTWVKLEQKGDGPGARSSHAITLVGGTAYAFGGEFTPRVPVDNAMYAFDLKSQCWSALDASGDVPPPRVGVTMASVGATVYMFGGRDQEHKELNELYSFDTATNRWTLLSSGAGDGPPHRSYHSMVADAAGGGKVYVFGGCGDAGRLNDLWAYDVAAGRWEALPSPGEACKPRGGPGLAVAGGKVWVVYGFSGEELDDVHCYDPGTGAWSTVETTGGGGGGDKPSPRSVFCAAGIGKHVVVFGGEVDPSDLGHLGAGKFSAEAFALDTETGAWARLDDAGEHHPGPRGWCAFSAGEVDGRRGLLVYGGNSPTNDRLGDIYFFTPPLA

SEQ ID NO: 10408 - protein, 170 aa, Saccharum officinarum
MSGNGVVKKVADAATKAGKAIDWDGLAKMLVSEEARKEFANLRRTFDDVNHQLQTKFSQEPQPIDWEYYKKGIGSKVVEMYKEAYESIEIPKYVDTVTPQYKPKFDALLVEMKEAEKASLKESERIEKEIAEMKEMKKKISTMTADEYFAKHPELKQKFDDEIRNDYWGY

SEQ ID NO: 10409 - protein, 170 aa, Setaria italica
MSGNAVVKKVADAAAKAGKAIDWDGLAKMLVSEEARKEFATLRRTFEDVNHQLQTKFSQEPQPIDWEYYRKGIGSKVVDMYKEAYESIEIPKYVDTVTPQYKPKFDALLVEMKEAEKASLKESERIEKEIAEMKEMKKKISTMTADEYFAKHPELKQKFDDEIRNDYWGY

SEQ ID NO: 10410 - protein, 170 aa, Panicum virgatum
MSGNGVVKKVADAAAKAGKAIDWDGLGKMLVSEEARKEFATLRCTFEDVNHQLQTKFSQEPKPIDWEYYRKGIGSKVVDMYKEAYESIEIPKYVDTVTPQYKPKFDALLVEMKESEKVSLKESERIEKEIAEMKEMKKKISTMTADEYFAKHPELKQKFDDEIRNDYWGY

SEQ ID NO: 10411 - protein, 170 aa, Cenchrus ciliaris
  misc_feature (53)..(53): Xaa can be any naturally occurring amino acid
  misc_feature (107)..(107): Xaa can be any naturally occurring amino acid
  misc_feature (150)..(150): Xaa can be any naturally occurring amino acid
MSGNGVVKKVADAAAKAGKAIDWDGLAKMLVSEEARKEFATLRRTFEDVNHQXRTKFSQEPQPIDWEYYRKGIGSKVVDMYKEAYESIEIPKYVDTVTPQYKPKFDXLLVEMKEAEKASVKESERIEKEIAEMKAMKKKISTMTADEYFXKHPELKQKFDDEIRNDYWGY

SEQ ID NO: 10412 - protein, 170 aa, Pennisetum glaucum
MSGSGVVKKVADAAEKAGKAIDWDGLAKMLVSEEARKEYATLRRTFEDVNHQLHTKFSQEPQPIDWEYYRKGIGSKVVDMYKVAYESIEIPKYVGTVTPQYKPKFDALLVEMKEAEKASLKESERIEKEIAEMKEMKKKISTMTADEYFVKHPELKQKFDDEIRNDYWGY

SEQ ID NO: 10413 - protein, 167 aa, Triticum aestivum
MSGVKKVTDVAAKAGKAIDWDGLAKMLVSDEARKEFANLRRTFEDVNHQLQTKFSQEPKPIDWEYYKKGIGSKVVDMYKEAYDSIEIPKYVDTVTPEYKPKFDALLIEMKEAEKTSLKESERIEKEIAELKEMKKKISTMTADEYFAKHPELKKKFDDEIRNDYWGY

SEQ ID NO: 10414 - protein, 167 aa, Secale cereale
MSGVKKVTDVAAKAGKAIDWDGLAKMLVSEEARKEFANLRRTFEDVNHQLQTKFSQEPKPIDWEYYRKGIGSKVVDMYKEAYDSIEIPKYVDTVTPEYKPKFDALLIEMKEAEKTSLKESERIEKEIAEMKEMKKKISTMTADEYFAKHPELKKKFDDEIRNDYWGY

SEQ ID NO: 10415 - protein, 167 aa, Hordeum vulgare
MSGVKKVADVAAKAGKAIDWDGMAKMLVSEEARKEFANLRRTFEDVNHQLQTKFSQEPQPIDWEYYRKGIGSKVVDMYKEAYDSIEIPKYVDTVTPQYKPKFDALLVELKEAEKTSLKESERIEKEIAEMKEMKKKISTMTADEYFAKHPELKKKFDDEMRNDYWGY

SEQ ID NO: 10416 - protein, 167 aa, Pseudoroegneria spicata
MSGVKKVTDVAAKAGKAIDWDGLAKMLVSDEARKEFANLRRTFEDVNHQLQTKFSQEPKPIDWEYYRKGIGSKVVDMYKEAYDSIEIPKYVDTVTPEYKPKFDALLIEMKEAEKTSLKESERIEKEIAEMKEMKKKISTMTADEYFEKHPELKKKFDDEIRNDYWGY

SEQ ID NO: 10417 - protein, 167 aa, Triticum aestivum
MSGVKKVTDVAAKAGKAIDWDGLAKMLVSDEARKEFANLRRTFEDVNHQLQTKFSQEPKPIDWEYYKKGIGSKVVDMYKEAYDSIEIPKYVDTVTPEYKPKFDALLIEMKEAEKTSLKESERIEKEIAELKELKKKISTMTADEYFAKHPELKKKFDDEIRNDYWGY

SEQ ID NO: 10418 - protein, 169 aa, Sorghum bicolor
MSGNGAKKVVDVAVKAAKAIDWDGMAKMLVSDEARKEFATLRRTFEDVNHQLQTKFSQEPQPIDWEYYRKGIGSKVVDMYKEAYESIEIPKYVDTVTPEYKPKFDALVVELKEAEKASLKESERIEKEIAELKEMKKKISTMTADEYFEKHPELKKKFDDEIRNDYWGY

SEQ ID NO: 10419 - protein, 169 aa, Saccharum officinarum
MSGNGAKKVVDVAVKAGKAIDWDGMAKMLVSEEARKEFATLRRTFEDVNHQLQTKFSQEPQPIDWEYYRKGIGSKVVDMYKEAYESIEIPKYVDTVTPEYKPKFDALVVELKEAEKASLKESERIEKEIAELKEMKKKISTMTADEYFEKHPELKKKFDDEIRNDYWGY

SEQ ID NO: 10420 - protein, 168 aa, Setaria italica
MSGNGKKVVDMAVKAGKAIDWDGMAKMLVSEEARKEFATLRRTFEDVNHQLQTKFSQEPQPIDWEYYRKGIGSKVVDMYKEAYESIEIPKYVDTVTPEYKPKFDALVVELKEAEKASLKESERIEKEIAELREMKKKISTMTADEYFEKHPEVKQKFDDEIRNDYWGY

SEQ ID NO: 10421 - protein, 168 aa, Pennisetum glaucum
MSGSGKKVVDVAVKAGKAIDWDGMAKMLVSEEARKEFATLRRTFEDVNHQLQTKFSQEPQPIDWEYYRKGIGSKVVDMYKEAYESIEIPKYVDTVTPEYKPKFDALVVELKEAEKASLKESERIEKEIAELKEMKKKISTMTADEYFEKHPEVKQKFDDEIRNDYWGY

SEQ ID NO: 10422 - protein, 168 aa, Cynodon dactylon
MSGKVKKVADAAAKAGRTIDWDGMAKMLVSDEARKEFATLRRTFEDVNHQLQTKYSQEPEPIDWEYYKKGIGSKVVDMYKEAYESIEIPKYVDTVTPQYKPKFDALVVELKDAEKASLKESERIEKEIAEMKEMKQKISTMTADEYFEKHPELKQKFDDEIRNDYWGY

SEQ ID NO: 10423 - protein, 167 aa, Leymus cinereus x Leymus triticoides
  misc_feature (6)..(6): Xaa can be any naturally occurring amino acid
  misc_feature (8)..(10): Xaa can be any naturally occurring amino acid
  misc_feature (138)..(138): Xaa can be any naturally occurring amino acid
MSGVKXVXXXAAKAGKAIDWDGMAKMLVSEEARKEFANLRRTFEDVNHQLQTKFSQEPQPIDWEYYRKGIGSKVVDMYKEAYDSIEIPKYVDTVTPQYKPKFDALLVELKEAEKTSLKESERIEKEIAEMKEMKKKIXTMTADEYFEKHPELKKKFDDEIRNDYWGY

SEQ ID NO: 10424 - protein, 169 aa, Oryza sativa
MSGNGVKKVAEVAAKAGKAIDWEGMAKMLVSDEARKEFNTLRRTFEDVNHQLQTKFSQEPQPIDWEYYRKGIGSKVVDMYKEAYESIEIPKYVDTVTPQYKPKFDALLVELKEAEKESLKESERIEKELAELQEMKKNISTMTADEYFAKHPEVKQKFDDEIRNDNWGY

SEQ ID NO: 10425 - protein, 169 aa, Panicum virgatum
MSGSGAKKVADVAVKAGKAIDWDGMAKMLVSEEARKEFATLRRTFEDVNHQLQTKFSQEPQPIDWEYYRKGIGSKVVDMYKEAYESIEIPKFVDTVTPEYKPKFDALVVELKEAEKASLKESERIEKEIAELREMKKKISTMTADEYFEKHPEVKQKFDDEIRNDYWGY

SEQ ID NO: 10426 - protein, 169 aa, Panicum virgatum
MSGSGAKKVADVAVKAGKAIDWDGMAKMLVSEEARKEFATLRRTFEDVNHQLQTKFSQEPQPIDWEYYRKGIGSKVVDMYKEAYDSIEIPKYVDTVTPEYKPKFDALVVELKEAEKASLKESERLEKEIAELREMKKKISTMTADEYFEKHPEVKQKFDDEIRNDYWGY

SEQ ID NO: 10427 - protein, 168 aa, Brachypodium distachyon
MSGSGKKVADLAVKAGKAIDWDGMAKMLVSEEARKEFATLRRTFEDVNNQLQTKFSQEPKPIDWEYYRKGIGAKVVDMYKEAYDSIEIPKYVDTVTPEYKPKFDALLVELKEAEQMSLKESERIEKEIAELREMKKKISTMTADEYFAKHPELKQKFDDEIRNDNWGY

SEQ ID NO: 10428 - protein, 167 aa, Avena sativa
MSGAKKVTDLAAKAGKAIDWDGMAKVLVSEEARKEFANLRRTFEDINHQLQTKYSQEPQPIDWEYYRKGIGAKVVDMYKEAYDSIEIPKYVDTVTPEYKPKFDALLVELKEAEKASLKESERIEKEIAEMKEMKKRISTMTADEYFEKHPELRKKFDDEIRNDYWGY

SEQ ID NO: 10429 - protein, 165 aa, Avena sativa
GVKKVTDLAAKAGKAIDWDGMAKVLVSEEARKEFANLRRTFEDINHQLQTKYSQEPQPIDWEYYRKGIGAKVVDMYKEAYDSIEIPKYVDTVTPEYKPKFDALLVELKEAEKASLKESERIEKEIAEMKEMKKKISTMTADEYFEKHPELRKKFDDEIRNDYWGY

SEQ ID NO: 10430 - protein, 168 aa, Brachypodium distachyon
MSGTVKKVADAASKAGKAIDWDGMAKMLVSEEARKEFANLRRTFEDVNNQLQTKFSQEPKPIDWDMYRKGIGSKVVDMYKEAYDSIEIPKYVDTVTPEYKPKFDALLVELKEAEQTSLKESERIEKEIAEMKEMKKKISTMTADEYFEKHPELRKKFDDEIRNDNWGY

SEQ ID NO: 10431 - protein, 168 aa, Cenchrus ciliaris
  misc_feature (66)..(67): Xaa can be any naturally occurring amino acid
  misc_feature (130)..(130): Xaa can be any naturally occurring amino acid
  misc_feature (142)..(142): Xaa can be any naturally occurring amino acid
MSGNGKKVADVAVKAGKAIDWDGMAKMLVSEDARREFATLRRTFEDVNHQLQTKFSQEPQPIDWEXXRKGIGSKVVDMYKEAYESIEIPKYVDTVTPEYKPKFDALVVELKEAEKASLKESERIEKEIAXLREMKKKISTMXADEYFEKHPEVKQKFDDEIRNDYWGY

SEQ ID NO: 10432 - protein, 169 aa, Cynodon dactylon
MSGSGAKKVADVAIKAGRTIDWDGMAKMLVSEEARKEFATLRRAFEDVNHQLQTKFSQEPEPIDWEYYRKGIGSKVVDMYKEAYESIEIPKYVDTVTPQFKPKFDALVVELKDAEKASLKESERIEKEIAELREMKKKISTMTADEYFEKHPEVKQKFDDEIRNDYWGY

SEQ ID NO: 10433 - protein, 159 aa, Secale cereale
MSGVKKVTDVAAKAGKAIDWDGLAKMLVSEEARKEFANLRRTFEDVNHQLQTKFSQEPKPIDWEYYRKGIGSKVVDMYKEAYDSIEIPKYVDTVTPEYKPKFDALLIEMKEAEKTSLKESERIEKEIAEMKEMKKKISTMTADEYFAKHPELKKKFDDE

SEQ ID NO: 10434 - protein, 167 aa, Festuca arundinacea
MSGVKKVTDLAAKAGKAIDWDGMAKMLVSEEARKEFANLRRTFEDVNHQLQTKYSQEPQPIDWEYYRKGIGAKVVDMYKQAYDSIEIPKFVDTVTPEYKPKFDALVVELKEAEKTSLKESERIDKEIAELREMKKKISTMTADEYFEKHPELKKKFDDEIRNDYWGY

SEQ ID NO: 10435 - protein, 169 aa, Eragrostis curvula
MSGSGSKKVADVAIKAGKAIDWDGLGKMLVSEEARKEFATLRRAFEDVNHQLQTKFSQEPQPIDWEYYRKGIGSNVVDMYKEAYGSIKIPKYVDTVTPEYKPKFEALVAEMKEAKKASLKESERIEKEIAELREMKKKISTMTADEYFEKHPEVKKKFDDEIRNDYWGY

SEQ ID NO: 10436 - protein, 169 aa, Musa acuminata
MSGNGVKKVAEVAAKATKSIDWDGMAKALVSDEARKEFANLRRAFDEVNSQLQTKFSQEPEPIDWEYYRKGIGSRLVDMYKEAYESIEIPKYVDTVTPEYKPKFDALLVELKEAEKQSLKESARLEKEIAEVQEMKKKISTMTADEYFENHPELKQKFDDEIRNDNWGY

SEQ ID NO: 10437 - protein, 169 aa, Musa acuminata
MSGNGVKKVAEVAAKATKSIDWDGMAKLIVSDEARKEFANLRRAFDEVNSQLQTKFSQEPEPIDWEYYRKGIGSRLVDMYKQAYESIEIPKYVDTVTPEYKPKFDALLVELKEAEKQSLKESARLEKEIAEVREMKKKISTMTADEYFEKHPELKQKFDDEIRNDNWGY

SEQ ID NO: 10438 - protein, 169 aa, Musa acuminata
MSGNGVKKVAEVAAKATKSIDWDGMAKLLVSDEARKEFANLRRSFDDVNHQLQTKFSQEPEPIDWEYYRKGIGSRLVDMYKQAYESVEIPKYVDTVTPEYKPKFDALLVELKEAEKQSLAESARLEKEIAEVQEMKQKISTMTADEYFERHPELKQKFDDEIRNDYWGY

SEQ ID NO: 10439 - protein, 166 aa, Avena sativa
MSGKKVAEVAVKAGRAIDWDGMAKMLVSEESRKEFATLRRTFEDLNHQLQTKYSQEPQPIDWEYYRKGIGSKVVDMYKEACDSIEIPKFVDTVTPEYKPKFDALVAELKEAEQISLKESERIEKEIAELKEMKKKISTMTADEYFEKHPELRQKFDDEIRNDYWGY

SEQ ID NO: 10440 - protein, 169 aa, Musa acuminata
MSGNGVKKVAEVAAKATKSIDWDGMAKVLVSDEARKEFANLRRSFDEVNHQLQTKFSQEPEPIDWEYYRKGIGSRLVDMYKQAYESVEIPKYVDTVTPEYKPKFDALLVELKEAEKKSLAESARLEKEIAEIQEMKQKISTMTADEYFESHPEVKQKFDDEIRNDYWGY

SEQ ID NO: 10441 - protein, 169 aa, Elaeis guineensis
MSGSGTKKVVEAAAKATKSIDWDGMAKLLVSEEARKEFVNLRRAFDDVNHTLQTKFSQEPEPIDWEYYRKGIGSRLVDMYKEAYEGIEIPKYVDTVTPEYKPKFDALLVELKEAEEKSVKESERLEKEIAEVQEMKKKISTMTADEYFEKHPELKKKFDDEIRNDYWGY

SEQ ID NO: 10442 - protein, 170 aa, Zea mays
MSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQYKPKFDAVIAELKEAEKEHQKESERIEKELAEMEEMRKKISTMTADDYFEKYPELRKKFDDEIRNDNWGY

SEQ ID NO: 10443 - protein, 169 aa, Elaeis guineensis
MSGSGTKKVVEAAAKATKSIDWDGMAKLLVSEEARKEFANLRRSFDEVNHALQTKFSQEPEPIDWEYYRKGIGSRLVDMYKEAYESIEVPKYVDNVTPEYKPKFDALLVELKEAEQKSLKDSERLEKEIAEVQEMKKKISTMTADEYFEKHPELKKKFDDEIRNDYWGY

SEQ ID NO: 10444 - protein, 103 aa, Eragrostis curvula
MSGNGKKVADVAIKAGKAIDWDGLAKMLVSEEARKEFATLRRTFEDVNHQLQTKFSQEPQPIDWEYYKKGIGSKVVDMYKEAYESIEIPKVCRYCYSRVQAEV

SEQ ID NO: 10445 - protein, 173 aa, Phalaenopsis aphrodite
MSGSGAKKVVETAVKATKAIDWDGMAKLLVSDEARKEFANLRRAFDDVNQQLQTKFSQEPEPIDWDYYRKGIGPRVVDMYKEAYDSVEIPKFVDTVTPQYKPKFDALLVELKEAEQASLKESERLEKEIDEVRELKQKISTMTAEEYFQKHPELKQKFDDEIRNDYWGYGPPQ

SEQ ID NO: 10446 - protein, 168 aa, Eucalyptus grandis
MSGTAKKVTDVAFKASKKIDWDGMAKLLVSDEARKEFANLRRAFSEVNSQLETKFSQEPEPIDWEYYRKGIGPRLVDMYKEAYDSIEIPKYVDTVTPQYKPKFDALLVELKEAEGMSLKESERLEKEIADVQELKKKISTMTADEYFEKHPELKKKFDDEIRNDYWGY

SEQ ID NO: 10447 - protein, 168 aa, Coffea canephora
MSGVAKKIADVTFKAGKTIDWEGMAKLVVSDEARKEFANLRRTFDEVNSQLQTKFSQEPEPIDWEFYRKGIGSKLVDMYKEAYESVEIPKYVDTVTPEYKPKFDALLVELKEAEQQSLKESERLEKEIAEVQELKKKLSTMTADEYFEKHPELRKKFDDEIRNDYWGY

SEQ ID NO: 10448 - protein, 168 aa, Gossypium hirsutum
MSGPGKKVVDVAFKASKNIDWEGMAKLLVSDEARKEFATFRRTFDEVNSTLQTKFSQEPEPIDWEYYRKGIGSRLVDMYKEAYESVEIPKFVDTVTPQYKPKFDALLVELKEAEEKSLKESERLEKEIAEVQELKQKISTMTADEYFEKHPELKKKFDDEIRNDYWGY

SEQ ID NO: 10449 - protein, 168 aa, Gossypium raimondii
MSGPGKKVVDVAFKASKNIDWEGMAKLLVSDEARKEFATLRRTFDEVNSTLQTKFSQEPEPIDWEYYRKGIGSRLVDMYKEAYESVEIPKFVDTVTPQYKPKFDALLVELKEAEEKSLKESERLEKEIAEVQELKQKISTMTADEYFEKHPELKKKFDDEMRNDYWGY

SEQ ID NO: 10450 - protein, 168 aa, Platanus occidentalis
MSGAGKKMADVAVKASKGIDWDGMAKLLVSEEARKEFSSLRRAFDEVNSTLQTKFSQEPEPIDWEYYRKGIGSRLVDMYKEAYDSIEIPKYVDTVTPQYKPKFDALLVELKEAEEKSLKESERLEKEIAEVQEMKKKISTMTANEYFEKHPELKKKFDDEIRNDYWGY

SEQ ID NO: 10451 - protein, 168 aa, Tabernaemontana elegans
MSGAGKKIADVTFKAGRTIDWDGMAKLIVSEEARKEFANLRRTFDDVNSQLQTKFSQEPEPIDWEYYRKGIGPKLVDMYKEAYESIEIPKYVDTVTPQYKPKFDALVEELKVAEQQSLKESERLEKEIAEVQELKKKLSTMTADEYFEKHPELKKKFDDEIRNDYWGY

SEQ ID NO: 10452 - protein, 350 aa, Zea mays
MFPMASSSLSSPPLSLILLRPLPCIPVLLLRQRKPFPAVRVEARSQQRLQRRPVTGQWRRSCRRGGGYACFSYNAKNKTPPPSDKSSDEWAIVRRWDVPWEWQTVVLSMVGCGVSFVLTGLVEQLALQELGFKAVEATIDEKAEILFFGQLSVTVVVLGVIFGITNTFRPFPDDVFRYDIKEPFKLQNGWLLWAGIGLFGAVISIALAGAAMTYLNGETPARETDSLVLLLPLIGSSTTSTAFLVGITGVLAPLLEETLFRGFLMVSLTKWFPTPACVLVSAAVFALAHLTPGQFPQLFILGVALGFSYAQTRNLLTPITIHAFWNSGVILLLTFLQLQGYDLKELLGAS

SEQ ID NO: 10453 - protein, 863 aa, Zea mays
MASPAGGESPAKPVLLHGDLDLWILEARLLPNMDMFSEHVRRCFAACRPPSSCGTKHPPPAAAGRRHHHHHRNIITSDPYVTLSVSGAVVARTAVIPNSQDPVWEERFAVPLAHRAADLEFQVKDNDTFGAQLIGTVAVPADRVVSGDEVEDWFPVIGTNGKPYKPDTALRLRFKFQPIADNPAYRHGIAGDPDHRGIQDSYFPLRHGGQLTLYQDAHVREGDLPEIELDNGKTFQHNACWEDICHAILEAHHMIYIVGWSVYDKVRLVREPSPSRPLPEGGDLTLGDLLKFKSQEGVRVCLLVWDDKTSHDKFFIKTGGVMATHDEETRKFFKHSSVICVLSPRYASNKLSIFKQQASFGQKFMVVGTLFTHHQKCVLVDTQARGNKRKITAFIGGLDLCDGRYDTPEHRLFKDLDTVFQNDYHNPTFSAGAKGPRQPWHDLHCRIDGPAAYDVLTNFEQRWRKATKWRDRFRRVSHWKDDALIKLERISWILSPSPNVPNNHPSLWVSKEEDHENWHVQVFRSIDSGSLKGFPSDCKAASKLNLVCRKNLVIDKSIHTAYVRAIRSAQHFIYIENQYFLGSSYAWPSYVNSGADNLVPIELALKIASKIKAGERFAVYVVIPMWPEGVPTAASVQEILFFQAQTMEMMYKIIADELKATDNKDMHPEDYLNFFCLGNREEPPSNGSPESEKSTDKSAAALASKYRRFMIYVHAKGMIVDDEYVILGSANINQRSLAGSRDTEIAMGAYQPHYAWSTKNGHPHGQVYGYRTSLWAEHLGTVDDRFKDPSSLECVRFVNQIAVENWQRFTAEEMSTLQGHLLKYPVKVEADGKISPLSDQECFPDVGGKILGAPTSLPDSLTM

SEQ ID NO: 10454 - protein, 859 aa, Zea mays
MASPAGGESPAKPVLLHGDLDLWILEARLLPNMDMFSEQVRRCLAVCRPPTSCGTNHPPAAARGGGGRQHHHRKIITRGPYVTLSVSGAVVARTAVIPNSQDPVWEERFAVPLAHRAAELEFQVKDNDTFGAQLIGTVTVPADCVVSGTEAEDWFPVKGTNGKPYKPDTALRLRFTFHPIANNPAYRHGIPGDPGHRGIGESYYPLRHGGQVTLYQDAHIREGDLPEIELDDGKTFQHNSCWEDICHAILEAHHMIYIVGWSVYDKVRLVREPSPSRPLPDGGDLTLGDLLKFKSQEGVRVCLLVWDDKTSHDKFFIKTGGVMATHDEETRKFFKHSSVICVLSPRYASNKLSIFKQQASFVVGTLFTHHQKCVLVDTQARGNKRKVTAFIGGLDLCDGRYDTPKHRLFKDLDTVFQNDYHNPTFSSGAKGPRQPWHDLHCRIDGPAAYDVLTNFEQRWRKATKWRGRFRRVSHWKDDALIKLERISWIISPSPNVPNDHPSLWVSKEEDRENWHVQVFRSIDSGSLKGFPSDCKEASKLNLVCRKNLVIDKSIHTAYVRAIRSAQHFIYIENQYFLGSSYAWPSYVNSGADNLIPIELALKIASKIRAQERFAVYVVIPMWPEGVPTAASVQEILFFQAQTMEMMYTIIADELKSMDNKDMRPEDYLSFFCLGNREEPPSNGSPESEKSTDKSAVGLATKYRRFMIYVHAKGMIVDDEYVILGSANINQRSLAGSRDTEIAMGAYQPHYAWSTKNGHPDGQVYGYRTSLWAEHLGTIDDRFKDPSSLECVRFVNQIAVENWRRYTAEEMSTLQGHLLKYPVKVEADGKISPLPDQECFPDVGGKILGASTSLPDSLTM

SEQ ID NO: 10455 - protein, 861 aa, Setaria italica
MASSAGGESPAKPKTVLLHGDLDLWIKEARLLPNMDLFSEQVRRCFAACRPPTSCGPKHPPAAAVPRGGSGGRHHHHRKIITSDPYVTLSVSGAVVARTAVIPNNQDPVWEERFAVPLAHRAAALEFQVKDNDTFGAQLIGTVTVPADIVASGEEVEDWYPIIGTNGKPYKPDTALCLRFRFQPIAENPAYRRGIPGDPERKGIKDSYFPLRHGGQVTLYQDAHVREGDLPEIELEDGKMFEHNACWEDICHAILEAHHMIYIVGWSVYDKVRLVRERSPSRPLPEGGDLTLGELLKFKSQEGVRVCLLVWDDKTSHDKFLFKTGGVMATHDEDTRKFFKHSSVICVLSPRYASNKLSIFKQQVVGTLFTHHQKCVLVDTQAWGNKRKVTAFIGGLDLCDGRYDTPEHRLFKDLDTVFHNDYHNPTFSAGAKGPRQPWHDLHCRIDGPAAYDVLTNFEQRWRKATKWRDRFRRVSHWKDDALIKLERISWILSPSRNVPNDHPSLWVSKEEDRENWHVQVFRSIDSGSLKGFPSDCKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQAQTMEMMYKIIADELKAMDIKDMHPQDYLNFFCLGNREEPSSNGSPESEKSTDKSAAALATKYRRFMIYVHAKGMIVDDEYVILGSANINQRSLAGSRDTEIAMGAYQPHHAWSTKNRHPHGQVYGYRTSLWAEHLGMVDDRFKDPSSLDCVRFVNQIAVENWQRFTAEEIRTLQGHLLKYPVNVEDDGKIGPLPDQENFPDVGGKILGAPTSLPDSLTM

SEQ ID NO: 10456 - protein, 856 aa, Oryza sativa
MESSAGGGGGESPPPAKPVLLHGDLDLWVVEARLLPNMDMFSEHVRRCFAACKPPTSCATARQPRHARGHHRRKIITSDPYVTLSVAGAVVARTRVIPNDQDPVWDERFAVPLAHYAAALEFHVKDNDTFGAQLIGTVTIPADRVASCQEVEDWFPIIGNNGRPYKPDTALRLRLRFNPAADNPLYRRGIPGDPDHQGIKDSYFPLRHGGRVTLYQDAHYREGDLPEIELDEGGKVFDHNACWEDICHAILEAHHMIYIVGWSVYDKVRLVREPSPSRPLPEGGDLNLGELLKFKSQEGVRVCLLVWDDKTSHDKLFIKTGGVMATHDEETRKFFKHSSVICVLSPRYASSKLSIFKQQVVGTLFTHHQKCVLVDTQAWGNKRKITAFIGGLDLCDGRYDTPEHRLFKDLDTVFDNDYHNPTFPSGAKGGPRQPWHDLHCRIDGPAAYDVLKNFEQRWRKATKWRERFRKVSHWKDDALIKLERISWILSPSPTIPNDDISLRVSKEEDPENWHVQVFRSIDSGSLKGFPSDCKEASKQNLICRKDLIIDKSIHTAYVRAIRSAQHFIYIENQYFLGSSYAWPSYVNSGADNLVPIELALKIASKIRAGERFAVYVVIPMWPEGVPTAASVQEILFFQAQTMEMMYRIIAQELKAMNIKNAHPQDYLNFYCLGNREESSSSNGSPESNDKSAAALARKYRRFMIYVHAKGMIVDDEYVILGSANINQRSLAGSRDTEIAMGAYQPHHTWSTKGGHPRGQVYGYRTSLWAEHLGMVDDLFKDPSSLECVNYVNEIAEENWRRFTAEQLITLQGHLLKYPVKVEADGKVGPLPEHECFPDVGGKILGAPTSLPDTLTM

SEQ ID NO: 10457 - protein, 858 aa, Brachypodium distachyon
MASPADGESPAKPILLHGDLDLWIIEARLLPNMDMFSEHIRRCFATCGTASSCAPKQPPRTRGGEGPNRRHHRKIITSDPYVTLSVAGAVVARTAVIPNSEEPRWGEQFFVPLAHRAAMLEFQVKDNDTFGAQLIGTASIPADRVTSACEEEVDEWFPIVGPSGRPYKPRTALHLRFRFRPLDTNPMYKHGIPGDPEKQGVQDSYFPLRHGGRVTLYQDAHVNEGDLPGIELERGKQFEHNNCWEDICHAILEAHHMIYIVGWSVYDKVKLVREPSPSRPLPEGGDLTLGDLLKFKSQEGVRVCLLVWDDKTSHDKLFIKTGGVMGTHDEETRKFFKHSSVICVLSPRYASSKLSIFKQQVVGTLFTHHQKCVLVDTQASGNKRKVTAFVGGLDLCDGRYDTPQHRLFKDLDTVFENDYHNPTFSAGAKGPRQPWHDLHCKIDGPAAYDVLKNFEQRWRKASKFRERFRKISHWKDDALIKLERISWILSPSPNIPNDHASLRVSKEEDPENWHVQVFRSIDSGSLKGFPSDCKEASKQNLVCRKNLIIDKSIHTAYVRAIRSAQHFIYIENQYFLGSSYGWPSYVNSGADNLIPMELALKIASKIRAGERFAVYVVIPMWPEGVPTAASVQEILYFQAQTMEMMYRVVAQELKTMNIENAHPQDYLNFYCLGNREESSTNGSPESDKSTDKSAAALARKYRRFMIYVHAKGMIVDDEYVILGSANINQRSLAGSRDTEIAMGAYQPHHSWSKKGAHPHGQVYGYRSSLWAEHLGMVDDRFKDPSSLDCVRFVNQIAEENWNRFTAEEMKTLQGHLLRYPVKVEPDGNIGPLPDQECFPDVGGKICGAPTSLPDSLTM

SEQ ID NO: 10458 - protein, 376 aa, Brachypodium distachyon
MASPADGESPAKPILLHGDLDLWIIEARLLPNMDMFSEHIRRCFATCGTASSCAPKQPPRTRGGEGPNRRHHRKIITSDPYVTLSVAGAVVARTAVIPNSEEPRWGEQFFVPLAHRAAMLEFQVKDNDTFGAQLIGTASIPADRVTSACEEEVDEWFPIVGPSGRPYKPRTALHLRFRFRPLDTNPMYKHGIPGDPEKQGVQDSYFPLRHGGRVTLYQDAHVNEGDLPGIELERGKQFEHNNCWEDICHAILEAHHMIYIVGWSVYDKVKLVREPSPSRPLPEGGDLTLGDLLKFKSQEGVRVCLLVWDDKTSHDKLFIKTGGVMGTHDEETRKFFKHSSVICVLSPRYASSKLSIFKQQASCWDIVYSSSKMCAG

SEQ ID NO: 10459 - protein, 862 aa, Triticum aestivum
MASSGGDESPSPAKPVLLHGDLDLWVVEARLLPNMDMFSEHIRRCFASCGTASSCAPRQPPPNSRGVGEAGSRRHHHRRIITSDPYVTLSVAGAVVARTAVIPNSQEPRWDEQFFVPLAHRATVLEFQVKDNDTFGAQLIGTASVPADRVVAAADELEEWVPIVGTSGKTYKPRTALFIRYRFRPFAANPVYRRGIPGDPDQQGVKDSYFPLRHGGKVTLYQDAHVNEGDLPDVELERGKKFEHNQCWEDICHAILEAHHMIYIVGWSIYDKVKLVREPSSSRALPEGGELTLGELLKFKSQEGVRVCLLVWDDKTSHDKLFIKTGGVMGTHDEETRKFFKHSSVICVLSPRYASSKLSIFKQQVVGTLFTHHQKCVLVDTQASGNKRKVTAFIGGLDLCDGRYDTPQHRLFKDLDTVFENDFHNPTFSAGAKGPRQPWHDLHCKIDGPAAYDVLKNFEQRWRKASKFRDRFRKVSRWKDDALIKLERISWILSPSPNVPNDHVSLRVSKEEDPENWHVQVFRSIDSGSLKGFPSDCKEASKQNLVCRKNLIIDKSIHTAYVRAIRSAQHFIYIENQYFLGSSYEWPSYVNSGADNLIPMELALKIATKIRAGERFAVYVVIPMWPEGVPTSASVQEILFFQAQTMEMMYGVIARELKAMNIEDANLQDYLNFYCLGNREEPSTDGSPESDKSTDKSAAGLARKHRRFMIYVHAKGMIVDDEYVILGSANINQRSLAGSRDTEIAMGAYQPHHAWSSKKGHPHGQVYGYRNSLWAEHLGMVDDHFKEPSSLECVRLVNQIAEENWERFASEEMKTLQGHLLRYPVKVESDGKIVPLPDQECFPDVGGKICGAPTSLPDSLTM

SEQ ID NO: 10460 - protein, 862 aa, Triticum aestivum
MASSGGDESPSPAKPVLLHGDLDLWVVEARLLPNMDMFSEHIRRCFASCGTASSCAPRQPPPNSRGVGEAGSRRHHHRRIITSDPYVTLSVAGAVVARTAVIPNSQEPRWDEQFFVPLAHRATLLDFQVKDNDTFGAQLIGTASVPAERVVAAVDEVEEWVPIVGTSGKTYKPRTALFIRYRFRPFAANPVYRRGIPGDPDQQGVKDSYFPLRHGGKVTLYQDAHVNEGDLPDVQLERGKKFEHNQCWEDICHAILEAHHMIYIVGWSIYDKVKLVREPSSSRPLPDGGELTLGELLKFKSQEGVRVCLLVWDDKTSHDKLFIKTGGVMGTHDEETRKFFKHSSVICVLSPRYASSKLSIFKQQVVGTLFTHHQKCVLVDTQASGNKRKVTAFIGGLDLCDGRYDTPQHRLFKDLDTVFENDFHNPTFSAGAKGPRQPWHDLHCKIDGPAAYDVLKNFEQRWRKASKFRDRFRKVSRWKDDALIKLERISWILSPSPNVPNDHVSLRVSKEEDPENWHVQVFRSIDSGSLKGFPSDCKEASKQNLVCRKNLIIDKSIHTAYVRAIRSAQHFIYIENQYFLGSSYEWPSYVNSGADNLIPMELALKIATKIRAGERFAVYVVIPMWPEGVPTSASVQEILFFQAQTMEMMYGVIARELKAMNIEDAHLQDYLNFYCLGNREEPSTDGSPESDKSTDKSAAGLARKHRRFMIYVHAKGMIVDDEYVILGSANINQRSLAGSRDTEIAMGAYQPHHAWSSKKGHPHGQVYGYRNSLWAEHLGMVDDHFKEPSSLDCVRLVNQIAEENWERFASEEMKTLQGHLLRYPVKVEPDGKIVPLPDQECFPDVGGKICGAPTSLPDSLTM

SEQ ID NO: 10461 - protein, 862 aa, Triticum aestivum
MASSGGDESPSPAKPVLLHGDLDLWVVEARLLPNMDMFSEHIRRCFASCGTASSCAPRQPPPNSRGVGEAGSRRHHHRRIITSDPYVTLSVAGAVVARTAVIPNSQEPRWDEQFFVPLAHRATVLEFQVKDNDTFGAQLIGTASVPADRVVAAADELEEWVPIVGTSGKTYKPRTALFIRYRFRPFAANPVYRRGIPGDPDQQGVKDSYFPLRHGGKVTLYQDAHVNEGDLPDVQLERGKKFEHNQCWEDICHAILEAHHMIYIVGWSIYDKVKLVREPSSSRALPEGGELTLGELLKFKSQEGVRVCLLVWDDKTSHDKLFIKTGGVMGTHDEETRKFFKHSSVICVLSPRYASSKLSIFKQQVVGTLFTHHQKCVLVDTQASGNKRKVTAFIGGLDLCDGRYDTPQHRLFKDLDTVFENDFHNPTFSAGAKGPRQPWHDLHCKIDGPAAYDVLKNFEQRWRKASKFRDRFRKVSRWKDDALIKLERISWILSPSPNVPNDHVSLRVSKEEDPENWHVQVFRSIDSGSLKGFPSDCKEASKQNLVCRKNLIIDKSIHTAYVRAIRSAQHFIYIENQYFLGSSYEWPSYVNSGADNLIPMELALKIATKIRAGERFAVYVVIPMWPEGVPTSASVQEILFFQAQTMEMMYGVIARELKAMNIEDANLQDYLNFYCLGNREEPSTDGSPESDKSTDKSAAGLARKHRRFMIYVHAKGMIVDDEYVILGSANINQRSLAGSRDTEIAMGAYQPHHAWSSKKGHPHGQVYGYRNSLWAEHLGMVDDHFKEPSSLECVRLVNQIAEENWERFASEEMKTLQGHLLRYPVKVEPDGKIVPLPDQECFPDVGGKICGAPTSLPDSLTM

SEQ ID NO: 10462 - protein, 931 aa, Secale cereale
LPPLPALPFGSASASAPRGWPRLPPPESPPPSGARRGCATGGPPGTGGPAPISSWPPPPPPPLPRPRRRRWRRRAGTSRRRRPSPCSCTGTSTSGSSRRGCCPTWTCSPSTSAAASPPAAPPPPARPGSPRQQPRRRGAGSRRHHHRRIITSDPYVTLSVAGAVVARTAVIPNSQEPRWDEQFFVPLAHRATLLEFQVKDNDTFGAQLIGTASVPADRVVAAADEVEEWVPILGTSGKTYKPRTALFIRYRFRPFAANPVYRRGIPGDPDQQGVKDSYFPLRHGGKVTLYQDAHVSEGDLPDVELERGKKFEHNQCWEDICHAILEAHHMIYIVGWSIYDKVKLVREASSSRPLPEGGELTLGELLKFKSQEGVRVCLLVWDDKTSHDKLFIKTGGVMGTHDEETRKFFKHSSVICVLSPRYASSKLSIFKQQVVGTLFTHHQKCVLVDTQASGNKRKVTAFVGGLDLCDGRYDTPQHRLFKDLDTVFENDFHNPTFSAGTKGPRQPWHDLHCKIDGPAAYDVLKNFEQRWRKASKFRDRFRKVSRWKDDALIKLERISWILSPSPNVPNDHVSLRVSKEEDPENWHVQVFRSIDSGSLKGFPSDCKEASKQNLVCRKNLIIDKSIHTAYVRAIRSAQHFIYIENQYFLGSSYEWPSYVNSGADNLIPMELALKIATKIRAGERFAVYIVIPMWPEGVPTSASVQEILFFQAQTMEMMYGVIARELKAMNIEDAHLQDYLNFYCLGNREEPSTDGSPESDKSTDKSAAGLARKHRRFMIYVHAKGMIVDDEYVILGSANINQRSLAGTRDTEIAMGAYQPHHAWSSKKGHPHGQVYGYRNSLWAEHLGMVDDHFKEPSSVDCVRLVNQIAEENWERFASEEMKTLQGHLLRYPVKVEPDGKIVPLPDQECFPDVGGKICGAPTSLPDSLTM

SEQ ID NO: 10463 - protein, 862 aa, Hordeum vulgare
MASSGGDESPSPPKPVLLHGDLDLWVLEARLLPNMDMFSEHIRRCFASCGTASSCAPRQPPPSSRGVGEAGSRRHHHRRIITSDPYVTLSVAGAVVARTAVIPNSQEPTWEEQFFVPLAHRATVLEFQVKDNDTFGAQLIGTASVPADRVVAAAEEVEEWVPIVGPSGKTYKPRTALCIRYRFRPFAANPVYRRGIPGDPDQQGVKDSYFPLRHGGKVTLYQDAHVNEGDLPDVQLERGKKFEHNQCWEDICHAILEAHHMIYIVGWSIYDKVKLVREPSSSRPLPEGGNLTLGDLLKFKSQEGVRVCLLVWDDKTSHDKLFIKTGGVMGTHDEETRKFFKHSSVICVLSPRYASSKLSIFKQQVVGTLFTHHQKCVLVDTQASGNKRKVTAFVGGLDLCDGRYDTPQHRLFKDLNTVFENDFHNPTFSAGTKGPRQPWHDLHCKIDGPAAYDVLKNFEQRWRKASKFRDRFRKVSRWKDDALIKLERISWILSPSPNVPNDHVSLRVSKEEDPENWHVQVFRSIDSGSLKGFPSDCKEASKQNLVCRKNLIIDKSIHTAYVRAIRSAQHFIYIENQYFLGSSYEWPSYVNSGADNLIPMELALKIATKIRAGERFAVYVVIPMWPEGVPTSASVQEILFFQAQTMEMMYGVIARELKAMNIENAHLQDYLNFYCLGNREEPTTDGSPESDKSTDKSAAALARKHRRFMIYVHAKGMIVDDEYVILGSANINQRSLAGSRDTEIAMGAYQPHHAWSSKKGHPHGQVYGYRNSLWAEHLGMVDERFKEPSSLECVRLVNQIAEDNWERFASEEMKMLQGHLLRYPVKVEPDGKIVPLPDQECFPDVGGKICGAPTSLPDSLTM

SEQ ID NO: 10464 - protein, 330 aa, Zea mays
MAAAPPAAEAALLLLLALLALAAVALRRGDALSLDLYDVTCPEVEAAVTAAVRQAMANDRTVAAGLLRMHFHDCFVRGCDGSVLLDSTATVTAEKDGPPNASLHAFYVIDNAKRAVEALCPGVVSCADILALAARDAVALSGGPWWVVPVGRRDGRVSLANETTAALPGPTASFDQLKQAFHGRGLSTKDLVALSGAHTLGFAHCSSFQNRILRAQQGVAAADDPSLSPSFAAALRRACPANNTVRAAGSALDATSAAFDNTYYRMLQAGRGLLSSDEALLTHPKTRAFVALYAASQEAFFRAFTKSMLRMAGLNGGQEVRANCRRVNPS

SEQ ID NO: 10465 - protein, 327 aa, Setaria italica
MAMASPTTTVILMAVAAAAALLGGAEALSLDLYDETCPEAEAAVTAAVRQAMAKDRTVAAGLLRMHFHDCFVRGCDASVLLDSTANVTAEKDGPPNASLHAFYVIDNAKAAVEALCPGVVSCADILALAARDAVALSGGPSWVVPVGRRDGRVSLASETSSALPGPRASFDQLKQAFHARGLSTKDLVVLSGGHTLGFAHCSSFQDRIRSPNGGGGADPALSPSFAASLRRACPANNTARAAGSGLDATEAAFDNTYYRMLQTGRGLLGSDDALLTHPKTRAFVALYAASQEAFFRAFAKSMLRMGGLNGGDEVRANCRRVNHHLSN

SEQ ID NO: 10466 - protein, 262 aa, Saccharum officinarum
MRRYSPPYRSPPRRGYGGRGRSPPPPPRRGYGGRNKEGSGSLLVRNIPLSVRAEELRVPFERFGPVRDVYIPKDYYSGEPRGFAFVEFVDPYDASEAQYHMNRQVFFGREIAVVLAAESRKRPEEMRSRARVRGYSGHEGRRSSYYGRSRSRSRSPRYRGRPRSRSYSPASRRRDDYSASPRRKEAHRASPPRRPPKEHDEDKKHRSYSPASRDDADNGYEKRSPLPDSDGSPPHRRSPKEYSGSPPGSRSRSADESPVRSD

SEQ ID NO: 10467 - protein, 259 aa, Setaria italica
MRRYSPPYRSPPRRGYGGRGRSPPPRRGYGGGRKEGSGSLLVRNIPLSVRAEDLRVPFERFGPVRDVYIPKDYYSGEPRGFAFVEFVDPYDASEAQYHMNRQVFFGREITVVLAAESRKRPEEMRSRARVRGYSGHEGRRSSYYGRSRSRSRSPRYRGRPRSRSYSPAPRRRDDYSASPRRKEAHRASPPRRPPKELDEDKKRRSYSPASRDDAENGYEKRSPPPDSDGSPPHRRSPKEYSGSPPGSRSRSAESPARSD

SEQ ID NO: 10468 - protein, 258 aa, Zea mays
MRRYSPPYRSPPRRGYGGRGRSPPPPRRGYGGRKEGSGSLLVRNIPLSVRAEDLRVPFERFGPVRDVYIPKDYYSGEPRGFAFVEFVDPYDASEAQYHMNRQVFFGREIAVVLAAESRKRPEEMRSRTRVRGYSGHEGRRSSYYGRSRSRSPRYRGRPRSRSYSPAPRRGNDYSASPRRQEAHRSSPPRRLPKEHDEDKKRRSYSPASRDDADNVYEKRSPPADSDGSPLHRRSPKEYSGSPPGSRSRSADDSPVASD

SEQ ID NO: 10469 - protein, 259 aa, Panicum virgatum
MRRYSPPYRSPPRRGYGGRGRSPPPRRGYGGRKEGSGSLLVRNIPLSVRSEDLRVPFERFGPVRDVYIPKDYYSGEPRGFAFVEFVDPYDASEAQYHMNRQVFFGREITVVLAAESRKRPDEMRNRARVRGYSGHEGRRSSYYGRSRSRSRSPRYRGRPRSRSYSPAPRRRDDYSVSPRRKEAQHTSPPRRPPKELDEDKRRRSYSPASRDDADNGYEKRSPPPDSDGSPPRRRSPRAYSASPPGSRSRSADESPARSD

SEQ ID NO: 10470 - protein, 260 aa, Pennisetum glaucum
MRRYSPPYRSPPRRGYGGRGRSPPPRRGYGGGRKESSGSLLVRNIPLSVRAEDLRVPFERFGPVRDVYIPKDYYSGEPRGFAFVEFVDPYDASEAQYHMNRQVFFGREITVVLAAESRKRPEEMRSRARVRGYSGHEGRRSSYYGRSRSRSRSPRYRGRPRSRSFSPGPRRRDDYSVSPRRKEAHRASPPRRPPKDLDEDKRRRSYSPASRDDAENGHEKRSPPPGSDGSPPHRRSPREYSGSPPGSRSRSPEESPARSD

SEQ ID NO: 10471 - protein, 265 aa, Oryza sativa
MRRYSPPYRSPPRRGYGGRGRSPPRRGYGGRKEQGSGSLLVRNIPLSCRAEDLRVPFERFGPVRDVYLPKDYYTGEPRGFAFVEFVDPYDASEAQYHMNRQVVFGREITVVLAAESRKRPEEMRSRARVRGYSDHEGRRSSHYGRSRSRSRSRSPRYRGRPRSRSYSPAPRRRDDYSASPQRKDTHRAKSPRRQPKEHEVDKKRRSYSPANKDGDRRDADNGYEKRSPPADSDGSPPHRRSPRQSSGSPPGSRSRSADGSPARSD

SEQ ID NO: 10472 - protein, 408 aa, Zea mays
MSALLDLLMGIFRQQTLGGAALELAALAAPLWLAALVGLLIGWAWRPRWAGVVVGDHNAQQAAQLPPPPAAAAVVPRNEAPAVVTRTVVAPAAPEDEQLAVNTRDLMHLWRLVQEKDGGPSWIHMMDRTLPTMRYQAWRRDPPNGPPQYRSSTIFEDASPEVVRDFFWDDEFRVKNSWDDMLLQYETLEQCAKTGTMVVRWVRKFPFFCSDREYIIGRRIWASGKTFYCVTKGVPRPSVPRQNKPRRVDLYYSSWCIRPVESRKGDGAMTACEVLLFHHEDMGIPWEIAKLGVRQGMWGCVKRIEPGLRAYQVARTAGEPISKHAAMAHVTTRFDADELVTEDSAEASSSSDNNKTAEVEKPKHWTNNIPKVLMIGGAVALACTFDGGLMTKAAIFGTARRFAGPGRR

SEQ ID NO: 10473 - protein, 297 aa, Saccharum officinarum
MAPPPAAVAAVRYHRPHLLLRRGGGGLLPSPPGPATLPFASRGAAASAPARLRLPPPRFSLSPVPKSLSASSHVPVRSLFTGIVEEVGRVRRLGPPLAPSFGGGGEAPGLDLEVETRDLLAGTQLGDSVAVDGTCLTVGGIEPAASTLTFGVAPETLRRTSLGGRAPGDGVNLERALTPSSRMGGHFVQGHVDGTGEIAAFRPDGDSLWVTVRAPPEILRLLVPKGFVAVDGTSLTVVSVDDEGGWFDFMLVRYTQDNIVLPTKKVGDKVNLEADILGKYVEKLLAGRVEAMAKVDS

SEQ ID NO: 10474 - protein, 298 aa, Zea mays
MAPPAAAVAAVRHHSPHLLLRRGGGGLLSSPSGPATLPFASRGAASAPARLRLPPPQFSLSPVPKSLSAASSSHVIVRSLFTGIVEEVGRVRRLGPPLAPSGGGGGEALGLDLEVETKDLLAGTQLGDSVAVDGACLTVAAIDPAASTLTFGVAPETLRRTSLGERAPGDGVNLERALTPSSRMGGHFVQGHVDGTGEIVAFRPDGDSLWVTVRAPPEILRLLVPKGFVAVDGTSLTVVSVDDEGGWFDFMLVRYTQDNIVLPTKKVGDKVNLEADILGKYVEKLLAGRVEAMAKVDS

SEQ ID NO: 10475 - protein, 297 aa, Zea mays
MAPPAAAVAAVHHRSPHLLLRRGGGGLLPSPSGPATLPFSSRGAACTPARLRLPPPRFSLSPVPKSLSAASSSHVPVRSLFTGIVEEVGRVRRLGPPLTPSGGGGGGEAPGLDLEVETKNLLAGTQLGDSVAVDGACLTVAAIDPAASTLTFGVAPETLRRTSLGGRAPGDGVNLERALTPSSRMGGHFVQGHVDGTGEIAAFRPDGDSLWVTVRAPPEILRLLVPKGFVAVDGTSLTVVSVDDEGGWFDFMLVRYTQDNIVLPTKKVGDKVNLEADILGKYVEKLLAGRVEAMAKG

SEQ ID NO: 10476 - protein, 300 aa, Setaria italica
MAPPPATAAAAAAVRHHRPHLLLRRGGGLLPSPSGPATLPFASRGAAARIRLPPPRFSLSPVPKSLSAASSASHVPVRSLFTGIVEEVGRVRRLGPPLAPSGGGGGGGEAPGLDLEVETKDLLAGTQLGDSVAVDGTCLTVAAIDPAASTLTFGVAPETLRRTSLGERAPGDGVNLERALTPSSRMGGHFVQGHVDGTGEIAAFRPDGDSLWVTVRAPPEILRLLVPKGFVAVDGTSLTVVSVDDEGGWFDFMLVRYTQDNIVLPTKKVGDKVNLEADILGKYVEKLLAGRVEAMAKADS

SEQ ID NO: 10477 - protein, 292 aa, Panicum virgatum
MAPPPATATAAASAAVRPHLILRRGGGLLLPSPPCAATLPFASRRLRLPPPRFSLSPVPKSLSAASHVPVRSLFTGIVEEVGRVRRLGPPLAPSGGGGGGEAPGLDLEVETKSLLAGTQLGDSVAVDGTCLTVAAIDPAASTLTFGVAPETLRRTSLGERAPGDGVNLERALTPSSRMGGHFVQGHVDGTGEIAAFRPDGDSLWVTVRAPPEILRLLVPKGFVAVDGTSLTVVSVDDEGGWFDFMLVRYTQDNIVLPTKKVGDKVNLEADILGKYVEKLLAGRVEAMAKVDS

SEQ ID NO: 10478 - protein, 337 aa, Setaria italica
MALPATCSTFCLKGAEQRGPPRWSFHRLSARAASLIGFGSCPRRGRLVLAGCARAGAGASDSKAVQLVLGGRARDDAGDTDSESSDDEGGEDGEVPMTDEERRTLRRKIREMMDRVPETAELTDPEERKAKMRELLTKYELVVEEEDPDWPEDAEDGMGFSLGQFFDKITIKAEKKDDADEEDDTGNQGDKEIVWEDDNYIKPIRDVKTQDWDASVFTDFGPMVVLVHNRYKRPQENEMARAELTKAIELFWEHNLPSPRCVAVDACAEADLVDALKVSGFPEILFTNAGRIIHREKVVRSAEAWSRMMAFFYYKAARPPFLCEADGKGQEKVPLMS

SEQ ID NO: 10479 - protein, 337 aa, Pennisetum glaucum
MALPATCSTFCLKGAEQRGLPALSLHRLPARAASLISFVSCPRRGRLVLAGCARAGAGANDSKAVQLVLGGRARDDAGDTNSESSDDEGGEDDEVPMTDEERKTLRRKIREMMDRVPETAELTDPEERKAKMRELLTKYELVVEEEDPEWPEDAEDGMGFNLGQFFDKITIKAEKKDDAEEEDDTGNQSGKDIVWEDDHYITPIRDVKTQDWDASVFTDFGPMVVLVHNRYKRPQENEMARAELTKAIEMFWEHNLPSPRCVAVDACAEPDLVNALKVSGFPEILFTNAGRIIHREKVVRSAEAWSRMMAFFYYKAARPLFLCEADGKGQEKVPLMS

SEQ ID NO: 10480 - protein, 418 aa, Sorghum bicolor
MELEAAPRQQQQQLEEEVEVVGCPCGGGSEAADQFERLHDAVLLDVLNRIGDVKALGRCALVSRRFHALVPLVNSVFVRVDCVIPDDPTPSAAAAAPGSPTHQAPAPAARGRGGALAHMARVLLGGIAKPIHALAQILSPAAAAVSRRSDPPLPASPPAPVADVSHHSPSEVLRSFRELRRLHIELPTGELGIDDGVLLKWKADFGSTLGSCVILGASSVLSKPPTGSTTQAEPAAADSTAAAPDTSRETEEPGSLPDSLYTNGGLKLRVVWTISSLIAASARHYSLHPIICNHETLESLDLTDADGQGVLTMDKRQLQELRVRPVSPSESSHRTLMPALSMRLHYAPLIELPGGTLLKGATLVAIRPSEDALSEGQGAGAAGPVGTCWISEALEEPYRTAAKVLLKRRAYCLEMNSF

SEQ ID NO: 10481 - protein, 234 aa, Hordeum vulgare
MGLGVRAAPFTYVAHALAVAAAAMVLYWCIHFRGGLAFEADNKNLIFNVHPVLMLIGFIILGSEAIMVYKVLPTVNHDTTKLIHLVLHAIALVLGAVGIYCAFKNHNETGIANLYSLHSWLGIGTISLYGIQWIFGFLTFFFPKAAPNVRKGALPWHVLLGIFVYILALATAELGFLEKLTFLQSSGIDKYGPESFLVNFTALVVVLFGASVVVAAVAPARLEEPQGYAPIPEN

SEQ ID NO: 10482 - protein, 234 aa, Triticum aestivum
MGLGVRAAPFTYVAHALAVVAAAMVLYWCIHFRGGLAFEADNKNLIFNVHPVLMLIGFIILGSEAIMIYKVLPTVNHDTTKLIHLVLHAIALVLGAVGIYCAFKNHNETGIANLYSLHSWLGIGTISLYGIQWIFGFLAFFFPKAAPNVRKGALPWHVLLGIFVYILALATAELGFLEKLTFLQSSGIDKYGPESFLVNFTALVVVLFGASVVVAAVAPARLEEPQDYAPIPEN

SEQ ID NO: 10483 - protein, 234 aa, Panicum virgatum
MGLGVRAAPFTYVAHALAIAAAVMVLVWAIHFRGGLAIEATDKNLIFNVHPVLMLIGYIIIGSEAIMVYKVFPTLKHDTAKLIHLILHGIALVLGAVGIYFAFKNHNESGIANLYSLHSWLGIGTITLYGIQWIFGFVTFFFPGAAPNLRRSLLPWHILFGLFVYILALANAELGFLEKLTFLESSGLDKYGTEAFLVNFTALVVVLFGASVVVAAVAPARLEEPQGYAPIPEN

SEQ ID NO: 10484 - protein, 277 aa, Saccharum officinarum
MALGLGVRAAPFTYAAHALAVAAAAMVLVWAIQFRGGLAIEATNKNLIFNVHPVLMLIGYIIIGSEAIMVYRVLPTTNHDTTKLIHLILHGIALVLGAVGIYFAFKNHNESGIANLYSLHSWIGIGTITLYGIQWIIGFVTFFFPGAAPNVKKGVLPWHILFGLFVYILALANAELGFLEKLTFLESGGVDGIWHRGILGELHSIGCRVIWCLCCGGCYSSSSPRRTTGLCSNSGKLVQMKCTAYAVARIGCYHMEIRYSYLFIKGEEDDGIITIRR

SEQ ID NO: 10485 - protein, 237 aa, Sorghum bicolor
MALGGLGVRAAPFTYAAHALAVAAAAMVLVWAIQFRGGLAIEATNKNLIFNVHPVLMLIGYIIIGGEAIMVYRVLPTTNHDTTKLIHLILHGIALVLGAVGIYFAFKNHNESGIANLYSLHSWIGIGTITLYGIQWIIGFVTFFFPGAAPNVKKGVLPWHILFGLFVYILALANAELGFLEKLTFLESSGLDKYGTEAFLVNFTALVVVLFGASVVVAAIAPVRLEEPQGYAPIPEN

SEQ ID NO: 10486 - protein, 236 aa, Zea mays
MGLGLGVRAAPFTYAAHALAVAAAAMVLVWSIQFRGGLAIESTNKNLIFNVHPVLMLIGYVIIGGEAIMVYRVLPTSNHDTTKLIHLILHGIALVLGAVGIYFAFKNHNESGIANLYSLHSWIGIGTITLYGIQWIIGFVTFFFPGAAPNVKKGVLPWHVLFGLFVYILALANAELGFLEKLTFLESSGLDKYGTEAFLVNFTALVVVLFGASVVVAAIAPVRLEEPQGYDPIPEN

SEQ ID NO: 10487 - protein, 236 aa, Zea mays
MGLGLGVRAAPFTYAAHALAVAAAAMVLVWAIYFRGGLAIEATNKNLIFNVHPVLMLIGYIIIGGEAIMVYRVLPTSNHETNKLIHLVLHGIALVLGAVGIYFAFKNHNESGIANLYSLHSWIGIGTITLYGIQWIVGFVTFFFPGAAPNVKKGVLPWHILFGLFVYILALANAELGFLEKLTFLESSGLDKYGTEAFLVNFTALVVVLFGASVVVAAIAPVRLEEPQGYVPIPEN

SEQ ID NO: 10488 - protein, 236 aa, Oryza sativa
MAAGLGVKAAPFTYVAHALAVAAAVMVLVWCISFRGGLAFEADNKNLIFNVHPVLMLIGYIILGSEAIMIYKIFPKLNHDTTKLIHLILHAIAIVLGAVGIYCAFKFHNESGIANLYSLHSWLGIGTISLYGIQWIFGFVAFFYPGAAPHVRRGALPWHVLFGLFVYVLTLATAELGLLEKLTFLQSSGLDKYGAEAFLVNFTGLVVALFGAAVVVAAVAPAHVEEPEGYAPIPVN

SEQ ID NO: 10489 - protein, 238 aa, Hordeum vulgare
MAVALGVKATPFTYAAHALAAAAAAMVLVWCIHFRGGLAFEAANKNLIFNVHPVLMLIGFIILGSEAIMVYKVFPGLNHDTAKLTHLILHAIAIVLGAVGIYCAFKFHNDSGIANLYSLHSWLGIGAISLYGIQWIFGFVTFFFPGAAPDVRRGALPWHALFGLFVYVLTLATAELGFLEKMTFLQSSGLDKYGPEALLVNFTALVVVLLGAAVVVAAVAPAATVEEPEGYAPIPVIG

SEQ ID NO: 10490 - protein, 238 aa, Hordeum vulgare
MAIALGVKATPFTYAAHALAAAAAAMVLVWCIHFRGGLAFEAANKNLIFNVHPVLMLIGFIILGSEAIMVYKVFPGLNHDTAKLTHLILHAIAIVLGAVGIYCAFKFHNDSGIANLYSLHSWLGIGAISLYGIQWIFGFVTFFFPGAAPDVRRGALPWHALFGLFVYVLTLATAELGFLEKMTFLQSSGLDKYGPEALLVNFTALVVVLLGAAVVVAAVAPAATVEEPEGYAPIPVIG

SEQ ID NO: 10491 - protein, 238 aa, Triticum aestivum
MAGALGVKATPFTYAAHALGAAAAAMVLVWCIHFRGGLAFEAVNKNLIFNVHPVLMLIGFIILGSEAIMVYKVFPGLSHDTAKLTHLILHAIAIVLGAVGIYCAFKFHNESGIANLYSLHSWLGIGAISLYGIQWIFGFVTFFFPGAAPDVRRGALPWHALFGLFVYVLTLATAELGFLEKMTFLQSSGLDKYGPEALLVNFTALVVVLFGAAVVVAAVAPAAKVEEPEGYAPIPVIG

SEQ ID NO: 10492 - protein, 76 aa, Pseudoroegneria spicata
MAGALGVKATPFTYAAHALAVAAAAMVLVWCIHFRGGLALEAVNKNLIFTFTRFLCSSASLSLAVKPSWSTRYFRD

SEQ ID NO: 10493 - protein, 242 aa, Lolium multiflorum
MAGALGVKATPFTYAAHVLAAAAAVMVLVWCIHFRGGLAFEAVNKNLIFNVHPVLMLIGYIILGSEAIMIYKSFPGLKHDTAKLIHLTLHAIAIVLGAVGIYCAFKNHNESGIANLYSLHSWLGIGAISLYGIQWIFGFVTFFFPGAAPDVRRGALPWHALFGLFVYILTLATAQLGFLEKLTFLESSGLDKYGTEAILVNCTALVVVLFGATVVVAAVAPAARWKNRRVMRRFRGRLVSTC

SEQ ID NO: 10494 - protein, 72 aa, Avena sativa
RGGEEGGGRSCRVRGEMAGELGVKATPFTYAAHSLAAAAAAMVLVWCIHFRGGLAFDAVNKNLIFNVHLFSC

SEQ ID NO: 10495 - protein, 238 aa, Brachypodium distachyon
MAGGLVGVKAAPFTYAAHALGAAAAVMVLVWCIHFRGGLAFDAVNKNLIFNVHPVLMLIGYIILGSEAIMIYKIFPKVNHDTAKLTHLILHAIAIVLGAVGIYCAFKFHNESGIANLYSLHSWLGIGAISLYGIQWIFGFVAFFYPGAAPGVRRGALPWHVLFGLFVYVLTLATAELGFLEKLTFLQSSGLDKYGAEAFLVNFTALVVVLFGAAVVVAAVAPKAQVPEPEGYAPIPVS

SEQ ID NO: 10496 - protein, 238 aa, Triticum aestivum
MAGALGVKATPFTYAAHALGAAAAAMVLVWCIHFRGGLALEAVNKNLIFNVHPVLMLIGFIILGSEAIMVYKVFPGLSHDTAKLTHLILHAIAIVLGAVGIYCAFKFHNESGIANLYSLHSWLGIGAISLYGIQWIFGFVTFFFPGAAPDVRRGALPWHALFGLFVYVLTLATAELGFLEKMTFLQSSGLDKYGPEALLVNFTALVVVLFGAAVVVAAVAPAAKVDEPEGYAPIPVIG

SEQ ID NO: 10497 - protein, 238 aa, Triticum aestivum
MAGALGVKATPFTYAAHALGAAAAAMVLVWCIHFRGGLALEAVNKNLIFNVHPVLMLIGFIILGSEAIMVYKVFPGLSHDTAKLTHLILHAIAIVLGAVGIYCAFKFHNESGIANLYSLHSWLGIGAISLYGIQWIFGFVTFFFPGAAPDVRRGALPWHALFGLFVYVLTLATAELGFLEKMTFLQSSGLDKYGAEALLVNFTALVVVLFGAAVVVAAVAPAAKVEEPEGYAPIPVIG

SEQ ID NO: 10498 - protein, 238 aa, Secale cereale
MAGALGVKATPFTYAAHALGAAAAAMVLVWCIHFRGGLALEAVNKNLIFNVHPVLMLIGFIILGSEAIMVYKVFPGLSHDTAKLTHLILHSIAIVLGAIGIYCAFKFHNESGIANLYSLHSWLGIGAISLYGIQWIFGFVTFFFPGAAPDVRRGALPWHALFGLFVYVLTLATAELGFLEKMTFLQSGGLDKYGPEALLVNFTALVVVLFGAAVVVAAVAPAAKVDEPEGYAPIPVIG

SEQ ID NO: 10499 - protein, 239 aa, Cynodon dactylon
MAASGLGVKAAPFTYAAHALAAAAAVMVLVWCVHFRGGLALEAENKNLIFNVHPVLMLIGYIILGGEAIMIYKIFPSWNHDTAKLTHLVLHAVATVLGAFGIYCAFKFHNDSGIANLYSLHSWLGIGTISLYGIQWIFGLVTFFFPGAAPSVRRAALPWHALFGLFVYVLALATAELGFLEKLTFLQSGGLSKYGAEAFLVNFTALVVVLFGATVVVAAVAPAQVNEEEPQGYAPIPVS

SEQ ID NO: 10500 - protein, 303 aa, Triticum aestivum
MGGGVMRTAAKVGLAGGAAAAAGRFRNVAPSFATAPAAEAAAAAPLLSAAGEIPAVAPAGSQWASWEVDDWEFADWRSESASEADVAVVGGPRLVFAPPSREEAEEATAELREAIDRVYFKETPVEVVKEHDQELSKLGADALIPAMPGHVVQAFTLLKSSPEAQSVVASLASDKNVWDAVLKNERVMEFYKSHQQTLVNTFPEGTDSTDSVESPEKFEEASPEYALPTASPLSDFVDNAKKTMMEMVDNITNFFQDLFHNPAEAEAGPGSSSKKPSFAEMAAGGSFMALAMAVILVVLFKRA

SEQ ID NO: 10501 - protein, 303 aa, Pseudoroegneria spicata
MGGGVMRTAAKVGLAGGAAAAAGRFRNVAPSFATAPAAEAAAAAPLLSAAGEIPAVAPAGSQWASWEVDDWEFADWRSESASEADVAVVGGPRLVFAPPSREEAEEATAELREAIDRVYFKETPVEVVKEHDQELSKLGADALIPAMPGHVVQAFTLLKSSPEAQSVVASLASDKNVWDAVLKNERVMEFYKSHQQTLVNTFPEGTDSTDSVESPEKFEEASPEYALPTASPLSDFVDNAKKAMMEMVDNITNFFQDLFHNPAEAEAGPSSSSKKPSFAEMAAGGSFMALAMAVILVVLFKRA

SEQ ID NO: 10502 - protein, 118 aa, Secale cereale
MGGGVMRTAAKVGLAGGAAAAAGRFRNVAPSFATASAAEAAGAAPLLSAAGEIPAVAPAGSQWASWEVDDWEFADWRSESASEADVAVVGGPRLVFAPPSREEAEEATAELREAIDRV

SEQ ID NO: 10503 - protein, 124 aa, Secale cereale
MGGGVMRTAAKVGLAGGAAAAAGRFRNVAPSFATASAAEAAGAAPLLSAAGEIPAVAPAGSQWASWEVDDWEFADWRSESASEADVAVVGGRGWCSPRRRGRRPRRLPPSSGKLLTGFILKRLQ

SEQ ID NO: 10504 - protein, 217 aa, Secale cereale
MGGGVMRTAAKVGLAGGAAAAAGRFRNVAPSFATAPAAEAAGAAPLLSAAGEIPAVAPAGSQWASWEVDDWEFADWRSESASEADVAVVGGPRLVFAPPSREEAEEATAELREAIDRVYFKETPVEVVKEHDQELSKLGADALIPAMPGHVVQAFTLLKSSPEAQSVVASLASDKNVWDAVLKNERVMEFYKSHQQTLVNTFPEGTDSTDSVESPRN

SEQ ID NO: 10505 - protein, 304 aa, Hordeum vulgare
MGGGVMRTAAKVGLAGGAAAAAGRFRNVAPSFATAPAAEAAAAAPLLSAAGEVPAVAPAGSQWASWEVDDWEFADWRSESATSEADVAVVGGPRLVFAPPSREEAEEATAELREAIDRVYFPETPVEAVKEHDQELSKLGADALIPAMPGHVVQAFTLLKSSPEAQSVVASLASDKNVWDAVLKNERVMEFYRSHQQTLINTFPEGTDSTDSVESPEKFEEASTEYALPTASPFSDFVDNAKKTMIEMVDNITNFFQDLFHNPAEAEAGPGSSSKKHSFAEMAAGGSFMALAMAVILVVLFKRA

SEQ ID NO: 10506 - protein, 301 aa, Leymus cinereus x Leymus triticoides
MGGGVMRTAAKVGLAGGAAAAAAGRFRNVAPSFATAPAAEAAAAAPLVSAAGEIPAVAPAGSQWASWEVDDWEFADWRDAAASEADVAVVEKPRLVFAPPSREEAEEATAELREAIDRVYFSETPVEVVKEHDQELSKLGADALIPSMPGHVVQAFTLLKSSPEAQSVVASLASDKNVWDAVLKNERVMEFYKSHQQTLVNTFPEDTDSVESPEKFEEASTEYALPTGSPLSDFVDSAKKMMMEMVDNITNFFQDMFHNPAEAEAAPSSSSKKPSFAEMAAGGSFMALAMAVILVVLFKRA

SEQ ID NO: 10507 - protein, 309 aa, Avena sativa
MGGGVMRTAAKVGIAGGAAAAAAGGRFRNVAPSFATAPAAEAAAAASLVSAAGEIPAVAPAGSQWTSWEVDDWEFADWRDAAVSDAEEAVVGRPRLVFAPPSLEEAEEATTELRDAIDRVYFPETPAQVVKEHDQELNKLGADALIPAMPGHVVQAFTLLKSSSEAQSVVASLASDKNVWDAVLKNEKVMEFYRSHQQTLVNTFPEDSGSVESPEKFEDTSTDYASPGELPTSSPLLDFVDNAKKTMMEMVDNITSFFQDLFHTPAETEAGPSSSTKKGSSPSFAEMAAGGSFMALAMAVILVVLFKRA

SEQ ID NO: 10508 - protein, 262 aa, Hordeum vulgare
AAPLLSAAGEVPAVAPAGSQWASWEVDDWEFADWRSESATSEADVAVVGGPRLVFAPPSREEAEEATAELREAIDRVYFPETPVEAVKEHDQELSKLGADALIPAMPGHVVQAFTLLKSSPEAQSVVASLASDKNVWDAVLKNERVMEFYRSHQQTLINTFPEGTDSTDSVESPEKFEEASTEYALPTASPFSDFVDNAKKTMIEMVDNITNFFQDLFHNPAEAEAGPGSSSKKHSFAEMAAGGSFMALAMAVILVVLFKRA

SEQ ID NO: 10509 - protein, 309 aa, Festuca arundinacea
  misc_feature (92)..(92): Xaa can be any naturally occurring amino acid
  misc_feature (143)..(143): Xaa can be any naturally occurring amino acid
  misc_feature (145)..(145): Xaa can be any naturally occurring amino acid
  misc_feature (212)..(212): Xaa can be any naturally occurring amino acid
  misc_feature (218)..(218): Xaa can be any naturally occurring amino acid
  misc_feature (309)..(309): Xaa can be any naturally occurring amino acid
MGGGVMRTAAKVGIAGGAAAAAAGGRFRNVAPAFATAPAAEAAAAASLVSAAGEIPAVAPAGSHWASWEVDDWEFADWREAAASDAEESVVXRPRLVFAPPSFEEAEEATTELKDAIDRVYFSETPVQVVKEHDQELNKLGAXAXIPAMPGHVVQAFTLLKSSSEAQSVVASLASDKNVWDAVLRNEKVMEFYRSHQQTLVNTFPEDTGSVXSPEKFXETSTDYASSGELPTGSALLDFVDNAKKTMMEVVENITNFFQDLFHNTADAEAGPSSSAKKGSSPSFAELAAGGSFMALAMAVILVVLFKRX

SEQ ID NO: 10510 - protein, 990 aa, Triticum aestivum
MATQSAVRLIGGAGAGGWTKDFGAFDSPLGNLPGEGLGFVENGSGIYGGWGESVPNRSGSAPPSMEGSLAALGNLIGQRSGNFDTSLGNLDNVTGSSTAEEQLRADPAYFDYYGSKVNLNPRLPPPLISRESRRFMNRVGKVKEWRVVSQDDSNKGSLFIPRSTLSTHKEEPEDDKSPRLDSSSADDEQMNLVDFVQESFQQNPDSLYDNSSHLSSSSIGDGVAVHSNIDSSMNLPHDVVKPSGLNSWTPVPLASVLRSTLSNNLSSTSVPSSSCSDNNPSVQISEQQQEKQSIDMKPGNDVPVSGAVVTELDVVDSSMKNLKLSLDSPTTSQVKQQWQGNFLQQYGFSPLVQGDHMPMTPHGAHLPHVPFVDNVSHTQLKLPTGDMQQLLPQLGMPTPFYTPNSFGSPYYQNLHPASVLANPYVTAGYALGGSGFPPVMTSYSPQSSAATPLDSPMTPSFSGRPSGFPSAGNLTAGTEFVQPYKMYGQLGVPMQPPIPDPNFFQFFQHPSFPQYASGNQYNTLAPRGSVFGNVADNFDPRKLFPQAQYPSDQRLQLPKTGIFNSPTTLRGGTVPNYHGISPYVGAPLTYPTSPVFQGQPFSGISPSGRNDSARFQSASRSMTAVSGFQGQREREKFDNPKACTFLEELKSNRARRVELSDITGRIVDFSADQHGSRFIQQKLENCTAEEKAAVFAEVLPHASSLMTDVFGNYVIQKFFEHGTPEQRRDLAAKLAGHVVPLSLQMYGCRVIQKALEVMELDQKIDLVRELDGNIMRCVRDQNGNHVIQKCIECVPTEHIGFVVSAFRGQVASLSMHPYGCRVIQRVLEHCGGDSRGQCIIDEILQSACILAQDQYGNYVTQHVVEKGKSHERAQIISKLAGQVVTMSQNKFASNVIEKCFQHGDIAERDLLIREIVEQTDGNDTLLAMMKDQYANYVVQKILETCNDEQRELLVSRVKGHLQALRKYTYGKHIASRVEQLCGEGDAECDS

SEQ ID NO: 10511 - protein, 989 aa, Secale cereale
MATQSAVRLIGGGGAGGWTKDFGAFDSPLGNLPGEGLGFVENGSGIYGGWGESVPNRSGSAPPSMEGSLAALGNLIGHRSGNFDASLGNLDNVTGSSTAEEQLRADPAYFDYYGSKVNLNPRLPPPLISRESRRFMNRVGKVKEWRVVSQDDSNKGSLFIPRSTLSTHKEEPEDDKSPRLDSSSADDEQMNLVDFVPESFQQNPDSLYSSSHLSSSSIGDGVAVHPNIDSSRNLSHDVVKPSGLNSWTPVPLASVLRSTLSNNLASTSVPSSSCSDNNPSVQISEQQQEKQSIDMKPGNDVPVSGAVVTELDVVDSSMKNLKLSLDSQTTPQVKQQWQGNFLQQYGFSPLVQGEHMPMTPHRAHLPHVPFVDNVSHTQLKLPTGDMQQLLPQLGMPTPFYAPNSFGSPYYQNLHPASVLANPYVTAGYALGGSGFPPVMTSYSPQSSAATPLDSPMTPSFSGRPSGFPSAGNLTAGTEFVQPYKMYGQLGVPMQPPIPDPNFFQFFQHPSFPQYASGNQYSTLAPRGSVFGNVADNFDPRKLFPQAQYPSDQRLQLPKTGISNSPTTLRGGTVPNYHGISPYVGAPLTYPTSPVFQGQPFSGMSPSGRNDSARFQSASRSMTAVSGFQGQREREKFDNPKACTFLEELKSNRARRVELSDITGRIVDFSADQHGSRFIQQKLENCTAEEKAAVFAEVLPHASSLMTDVFGNYVIQKFFEHGTPEQRRDLAAKLAGHVVPLSLQMYGCRVIQKALEVMELDQKIDLVRELDGNIMRCVRDQNGNHVIQKCIECVPTEHIGFVVSAFRGQVASLSMHPYGCRVIQRVLEHCGGDSRGQCIIDEILQSACILAQDQYGNYVTQHVVEKGKSHERAQIISKLAGQVVTMSQNKFASNVIEKCFQHGDIAERDLLIREIVEQTDGNDTLLAMMKDQYANYVVQKILETCNDEQRELLVSRVKGHLQALRKYTYGKHIASRVEQLCGEGDVECDS

SEQ ID NO: 10512 - protein, 111 aa, Pseudoroegneria spicata
  misc_feature (25)..(25): Xaa can be any naturally occurring amino acid
MKEATASGGGATAGANDPRQPTTAXPYAPPKLSSQDLPVDYAGFLAVVFGVVGVMLHYKVCSWIAIIFCAQSLANMKNFENDLKQLSMAFMFAVMGLVTNYFGPRPGGTKR

SEQ ID NO: 10513 - protein, 111 aa, Secale cereale
MKEATASGGGATAGANDPRQPATARPYAPPKLSSQDLPVDYAGFLAVVFGVVGVMLHYKVCSWIAIIFCAQSLSNMKNFENDLKQLSMAFMFAVMGLVTNYFGPRPGGAKR

SEQ ID NO: 10514 - protein, 111 aa, Hordeum vulgare
MKEATASGGGAAAGANDPRQPTTARPYAPPKLSSQDLPVDYAGFLAVVFGVVGVMLHYKACSWIAIIFCAQSLANMKNFENDLKQLSMAFMFAVMGLVTNYFGPRPGGTKR

SEQ ID NO: 10515 - protein, 111 aa, Secale cereale
MKEATASGGGAAAGANDPRQPATARPYAPPKLSSQDLPVDYAGFLAVVFGVVGVMLHYKVCSWIAIIFCAQSLSNMKNFENDLKQLSMAFMFAVMGLVTNYFGPRPGGAKR

SEQ ID NO: 10516 - protein, 111 aa, Avena sativa
MKEATTSGGATAGANDPRQPTTARPYAPPKLSSQDLPVDYAGFLAVVFGVVGVMMHYKVCSWIAIIFCAQSLANMKNFENDLKQLSMAFMFAIMGLVTNYFGPPRPGSVKR

SEQ ID NO: 10517 - protein, 111 aa, Brachypodium distachyon
MKEATTPGGASTGANDPRQPTTARPYAPPKLSSQDLPVDYAGFLAVVFGVIGVMLRYKVCSWIAIIFCAQSLANMKNFENDLKQLSMAFMFAVMGLVTNYFGPPRPGTTKP

SEQ ID NO: 10518 - protein, 112 aa, Unknown
  Sequence found in Organisms: Sorghum bicolor, Saccharum officinarum
MKEGSSSGGGAFAGGSDPRQPSTAKPYAPPKLSPQDLPIDYAGFLAVVFGVVGVMLRYKVCSWIAIIFCAQSLANMKNFENDLKQLSMAFMFAVMGLVTNYFGPPRPGSTKR

SEQ ID NO: 10519 - protein, 123 aa, Secale cereale
  misc_feature (3)..(3): Xaa can be any naturally occurring amino acid
TRXKKKRREGGEMKEATASGGGATAGANDPRQPATARPYAPPKLSSQDLPVDYAGFLAVVFGVVGVMLHYKVCSWIAIIFCAQSLSNMKNFENDLKQLSMAFMFAVMGLVTNYFGPRPGGAKR

SEQ ID NO: 10520 - protein, 105 aa, Avena sativa
MKEATTSGGASAGANDPRQPTTARPYAPPKLSSQDLPVDYAGFLAAVFGVVGVMMHYKVCSWIAIIFCAQSLANMKNFENDLKQLSMAFMFAIMGLVTNYFGPPR

SEQ ID NO: 10521 - protein, 112 aa, Cenchrus ciliaris
MKEGSSSGGGAAAGGSDPRQPSTAKPYAPPKLSPQDLPIDYAGFLAVVFGVVGVMLRYKACSWIAIIFCAQSLANMKNFENDLKQLSMAFMFAVMGLVTNYFGPPRPGSTKS

SEQ ID NO: 10522 - protein, 112 aa, Pennisetum glaucum
MKEGSSSGGGAAAGGSDPRQLSTAKPYAPPKLSPQDLPIDYAGFLAVVFGVVGVMLRYKVCSWIAIIFCAQSLANMKNFENDLKQLSMAFMFAVMGLVTNYFGPPRPGSTKS

SEQ ID NO: 10523 - protein, 112 aa, Zea mays
MKDGTSSGGGAFAAGSDPRQPSTAKPYAPPKLSPQDLPIDYAGFLAVAFGVLGVMLRYKVCSWIAIIFCAQSLANMKNFENDLKQLSMAFMFAVMGLVTNYFGPARPGSTKR

SEQ ID NO: 10524 - protein, 113 aa, Oryza sativa
MKEATSSGGGGGGGAGVNDPRQPSTARQYTPPKLSPQDLPIDYAGFLAVVFGVLGVMLRYKVCSWIAIIFCAQSLVNMKNFENDLKQLSMAFMFAVMGLVTNYLGPPRPGTKR

SEQ ID NO: 10525 - protein, 78 aa, Triticum aestivum
  misc_feature (11)..(11): Xaa can be any naturally occurring amino acid
DDRDEGRNVVXGRGVRCGQRSKAAVDGEHYAPPKLSPQDLPIDYAGFLAVAFGSSASCSATRCARGSQSSSALSRWQT

SEQ ID NO: 10526 - protein, 483 aa, Secale cereale
MSCFFCFGPAVEAEAAKPGPDAKDPRAAAPDRAGSDKLRLQGGSDPKNNHLAIPRDGSSQNIAAQIFTFRELAAATKNFRQDCMLGEGGFGRVYRGRLESGQAVAVKQLDRNGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNILLGEGFHPKLSDFGLAKLGPVGDNTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPTQHTRSNSSTPRARNVGGRNSEQRNGRSPNHHSPRTSKHGGEVSRTSSTGGDSGRRSGLDDMDMAGSQAGSPAQTVRKRETPRTADRQRAIADAKIWGENSRERKRPNGHGSFDSTNE

SEQ ID NO: 10527 - protein, 498 aa, Brachypodium distachyon
MSCFSCFGSAQAAAAAGEAEKPGHARKDGAAADRGAAPHKGGSDKVRPQGGSDSKKDHLTIPRDANSQNIAAQIFTFRELATATKNFRQDSLLGEGGFGRVYKGRLDNGQAVAVKQLDRNGLQGNREFLVEVLMLSLLHHTNLVNLIGYCADGDQRLLVYEFMPLGSLEDHLHDVPPDKEPLDWNTRMKIAAGAAKGLEHLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNTPVQHNRSNSSTPRARNVVRRNEDPRSARSPNHHSPDLRREAARASKYGAEVSRTSSAGDSGRRSGLDDMDMAGTQVGSPAQTGRKRETPRTADRQRAIADAKSWGQNSRERKLSNGHGSFDSSTNE

SEQ ID NO: 10528 - protein, 491 aa, Zea mays
MSCFVCFGSAAQDEEPRKPAAAGAGKDAAPDRAVARVGSDKSRSQGGPDSKKDLIIHKDGNSQNIAAQTFTFRELAAATKNFRQDCLLGEGGFGRVYKGRLENGQAVAVKQLDRNGLQGNREFLVEVLMLSLLHHTNLVNLIGYCADGDQRLLVYEFMPLGSLEDHLHDLPPDKEPLDWNTRMKIAAGAAKGLEHLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKTQGEQNLVAWARPLFKDRRKFPKMADPMLQGRFPMRGLYQALAVAAMCLQEQAATRPHIGDVVTALSYLASQAYDPNAPVQHVRSNSSTPRARNPAGWNGDQRSVRSPNHHSPDPRRRDAAGASKYGAEVSRTSSTSDSGRRSGLDDMDLTGSQVGSPAQTGRRREAPRGTDRQRAVAEARTWGENSRERTNGHGSFDSTHE

SEQ ID NO: 10529 - protein, 344 aa, Hordeum vulgare
MDEAGTSASAGSAPRGGRPARSGVFYKFTQQDLPAWKPAMTPGYVIAIFLVIGIIFVPVGLICLQASNRVAEVVHRYDIDCLPNAYRSNKQAYIKDSSISKKCIQKVKVQYHMKAPIYVYYELDNYYQNHRRYIKSRSDKQLRYGLKYTDSSCSPIERSNGLPIVPCGLIAWSLFNDTYDFTRGSMGIMVDRKNISWRSDREHKYGKDVYPFNFQNGSLIGGGKLDPDIPLSNQEDLIVWMRAAALPQFRKLYGVIEEDIQADEIITMHITNNYNTYSFGGKKSLVLTTSTWLGGKNDFLGYAYLITGSSSIFLSIVFALIHVKIPRPQGDAAYLSWSRKNGNN

SEQ ID NO: 10530 - protein, 344 aa, Triticum aestivum
MDEAGTSASAGSAPRGGRPARSGVFYIFTQQDLPAWKPAMTPGYVIAIFLIIGIIFVPVGLICLQASNRVAEIVHRYDIDCVPNAYRSNKQAYIKDSSISKKCIQKVKVQYHMKAPIYVYYELDNFYQNHRRYIKSRSDKQLRHGLQYTDSSCSPMERSNGLPVVPCGLIAWSLFNDTYDFTRGSMGLMVDRKNISWRSDREHKYGQDVYPFNFQNGSLIGGGKLDPDIPLSNQEDLIVWMRAAALPQFRKLYGVIEEDIQADETITMHITNNYNTYSFGGKKSLVLTTSTWLGGKNDFLGYAYLITGSSSIFLSILFALIHVKIPRPHGDAAYLSWSRKNGNN

SEQ ID NO: 10531 - protein, 327 aa, Secale cereale
MDEAGTSASAGSAPRGGRPARSGVFYKFTQQDLPAWKPAMTPGYVIAIFLIIGIIFVPVGLICLQASNRVAEIVHRYDIDCVPNAYRSNKQAYIKDSSISKKCIQKVKVQYHMKAPIYVYYELDNFYQNHRRYIKSRSDKQLRYGLKYTDSSCSPIEKSNGLPIVPCGLIAWSLFNDTYDFTRGSMGLMVDRKNIAWRSDREHKYGKDVYPFNFQNGSLIGGGKLDPDIPLSNQEDLIVWMRAAALPQFRKLYGVIEEDIQADETITMHITNNYNTYSFGGKKSLVLTTSTWLGGKNDFLGYAYLITGSSSIFLSILFALIHVKIPR

SEQ ID NO: 10532 - protein, 327 aa, Triticum aestivum
RPARSGVFYKFTQQDLPAWKPAMTPGYVIAIFLIIGIIFVPVGLICLQASNRVAEIVHRYDIDCVPNAYRSNKQAYIKDSSISKECIQKVKVQYHMKAPIYVYYELDNFYQNHRRYIKSRSDKQLRHGLQYTDSSCSPIERSNGLPVVPCGLIAWSLFNDTYDFTRGSMGLMVDRKNISWRSDREHKYGQDVYPFNFQNGSLIGGGKLDPDIPLSNQEDLIVWMRAAALPQFRKLYGVIEEDIQADETITMHITNNYNTYSFGGKKSLVLTTSTWLGGKNDFLGYAYLITGSSSIFLCILFALIHVKIPRPHGDAAYLSWSRKNGNN

SEQ ID NO: 10533 - protein, 346 aa, Brachypodium distachyon
MEEASTSANGGSAAGGGRSFPPARSGVFYKFTQQDLPAWKPAMTPGCVITIFLLIGITFVPVGLVCLQASNSVAEIVHRYDIDCVPDAYRRNKQAYIKDSLISKKCIQKVKVQYHMKAPIYVYYELDNFYQNHRRYVKSRSDKQLRHGMKYTDSSCGPLERNNGLPIVPCGLIAWSLFNDTFGFTRGSIGIMVDRKNISWRSDREHKFGKDVYPFNFQNGSLIGGGKLDPDIPLSNQEDLIVWMRAAALPQFRKLYGVIEDDLQADETIDIHITNNYNTYSFGGKKSLVLTTSTWLGGKNDFLGYAYLVTGSASIFLSILFALIHVKIPRPHGDAAYLSWSRKSSN

SEQ ID NO: 10534 - protein, 298 aa, Triticum aestivum
AIFLIIGIIFVPLGLICLQASNRVAEIVHRYDIDCVPNAYRSNKQAYIKDSSISKECIQKVKVQYHMKAPIYVYYELDNFYQNHRRYIKSRSDKQLRYGLKYTDSSCSPIEKSDGLPIVPCGLIAWSLFNDTYDFTRGSMGIVVDRKNISWRSDREHKYGKDVYPFNFQNGSLIGGGKLDPDIPLSNQEDLIVWMRAAALPQFRKLYGVIEEDIQADEIITMHITNNYNTYSFGGKKSLVLTTSTWLGGKNDFLGYAYLITGSLSIFLSILFALIHVKIPRPHGDAAYLSWSRKNGNN

SEQ ID NO: 10535 - protein, 350 aa, Oryza sativa
MEEASTSASGGGGAAANGGQRGFPPARSGVFYRFTQQNLPAWKPAMTPGCVITIFLMIGVTFVPVGLVCLHASNHVAEIAHRYDIDCVPNAYKRNRQAYIKDSSISKNCTQEVKVKYLMRAPIYVYYELDNFYQNHRRYVKSRSDKQLRYGQKYTHSSCDPIERNDGLPIVPCGLIAWSLFNDTYGFTCGSTEIKVNRKNISWKSDREHKFGKDVYPFNFQNGSLIGGGKLDPALPLNQQEDLIVWMRTAALPQFRKLYGVIEEDLQADEIITMHIANNYNTYSFGGKKSLILTTSTWLGGKNDFLGYAYLITGSLSLFLTILFALIHVKNPRPHGDANYLSWNRPNSNS

SEQ ID NO: 10536 - protein, 192 aa, Pseudoroegneria spicata
VDSSLHLYPFCLLLHGHASNPLLLHVRQRHRYTPSAAPDGNSGDTSTAPSEPPPTDTQPSPPPSAPPSTNSGTTSVKTRLRSRNQARRVQEAYLPPVEVKMMRGKGKANASAAPRREKEKRKKTWDEMSLGEKAYELYVGEKGALFWLNKFAYASIFIMAGAWILFRFVGPATGLYQLDAPPLAPTDVLRGS

SEQ ID NO: 10537 - protein, 193 aa, Avena sativa
MKHLLLASPLPLLLHGSASKPAHLHIRRRRCYVPSAAPDGNSGDTSTAASEPSTDTQPSPPPSEPTSTSSNPTSVKDRLRSRNQARRTPEVVYLPPVEVRMMRGKTKAKEAAAPPRREKQRKKKGWDEMSLAEKALELYVGEKGALFWLNKFAYASIFIMAGAWILFRFVGPVTGLYQLDAPPLAPVDVLRGS

SEQ ID NO: 10538 - protein, 565 aa, Triticum aestivum
MKSLLGEERSFIIESDDDDEEDPAHRGDGVGHGDDGSSSDSSSCATPRGGGGDSQPNSYTNQWPQSYRQSIDILSNVQSPSLGFLGTPTLSRLSNSFLNSSFLNSSFRGKTPEIVSNLVKPLIRPTTSDEQQQQQQHEDIRKSSQYLLPSRKPSLQQIPEDQKPLVVGHEVSPYQQCSYTQGAMNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLNIGGLTINSHVFFAILTTLVVMPTTWLRDLTCLSYISAGGVVASILVVICLCWIGVVDMSASRTKDCVKPPGNPIAIGLYGYCYSGHGVFPNIYSSLKNRNQFPSILFTCIGFSTILFTAAAVMGYKMFGESTESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYAT

SEQ ID NO: 10539 - protein, 573 aa, Secale cereale
MKSLLGEERSFMIESDEEDEEDPAHRDGAGGGHGDDDGSSSDSSSCATPRGGGGDSQPNSYTNQWPQSYRQSIDILSNVQSPSLGFLGTPTLSRLSNSFLNSSFLNSSFRGKTPEIVSNLVKPLIRPTTSDEQQQQQQQQQQQHEDIRKSSQYLLPSRKPSLQQIPEDRKPAVVGHEVSPYQQCSYTQGAMNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLNIGGLTINSHVFFAILTTLVVMPTTWLRDLTCLSYISAGGVVASILVVICLCWIGVVDNVGFENKGTALNLPGIPIAIGLYGYCYSGHGVFPNIYSSLKNRNQFPSILFTCIGFSTILFTAAAVMGYKMFGESTESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYAS

SEQ ID NO: 10540 - protein, 567 aa, Hordeum vulgare
MKSLLGEERSFIIESDDDDDEEDPIHKDGAGGSSSDSSSCASPRGGSGGGGGDSQPNSYTNQWPQSYRQSIDILSSVQSPSLGFLGTPTLSRLSNSFLNSSFLNNSFRGKTPEVISNLVKPLIRPTTSDEQQQQQQHHEDIRKSSQYLLPSRKPSLQQIPEDQKPLVVGHEVSPYQQCSYTQGAMNGINVLCGVGILSTPYAIKQGGWIGLVILIVFALLAWYTGVLLRRCLDSKEGLQTYPDIGHAAFGTTGRIAISIILYVELYACCIEYLILESDNLSKLFPNVHLNIWGLAINSHVFFAILTTLVVMPTTWLRDLTCLSYISAGGVVASILVVICLCWIGVVDHVGFENKGTALNLPGIPIAIGLYGYCYSGHGVFPNIYSSLKNRNQFPSILFTCIGFSTILFTAAAVMGYKMFGESTESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYST

SEQ ID NO: 10541 - protein, 191 aa, Secale cereale
MVHRSAAAPLPGQQGGPPDVPGYRPCRLWHHRSHSHLDNPVRGTVCLLHRVLDTGKRQFIQVVPKCAPEHWGLTINSHVFFAILTTLVVMPTTWLRDLTCLSYISAGGVVASILVVICLCWIGVVDNVGFENKGTALNLPGIPIAIGLYGYCYSGHGVFPNIYSSLKNRNQFPSILFTCIGFSTICLLPPR

SEQ ID NO: 10542 - protein, 541 aa, Secale cereale
GEEDGSSSDSSSCATPRGGGGGDSQPNSYTNQWPQSYRQSIDILSNVQSPSLGFLGTPTLSRLSNSFLNSSFLNSSFRGKTPEIVSNLVKPLIRPTTSDEQQQQQQQQQQQHEDIRKSSQYLLPSRKPSLQQIPEDRKPAVAGHEVSPYQQCSYTQGAMNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLSIGGLTINSHVFFAILTTLVVMPTTWLRDLTCLSYISAGGVVASILVVICLCWIGVVDNVGFENKGTALNLPGIPIAIGLYGYCYSGHGVFPNIYSSLKNRNQFPSILFTCIGFSTILFTAAAVMGYKMFGESTESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYAS

SEQ ID NO: 10543 - protein, 537 aa, Secale cereale
DGSSSDSSSCATPRGGGGDSQPNSYTNQWPQSYRQSIDILSNVQSPSLGFLGTPTLSRLSNSFLNSSFLNSSFRGKTPEIVSNLVKPLIRPTTSDEQQQQQQQQQQQHEDIRKSSQYLLPSRKPSLQQIPEDRKPAVAGHEVSPYQQCSYTQGAMNGINVLCGVGILSTPYAIRQGGWLGLVILVVFALLAWYTGVLLRRCLDSKEGLQTYPDIGHAAFGTTGRIAISIILYVELYACCIEYLILESDNLSKLFPNVHLNIGGLTINSHVFFAILTTLVVMPTTWLRDLTCLSYISAGGVVASILVVICLCWIGVVDNVGFENKGTALNLPGIPIAIGLYGYCYSGHGVFPNIYSSLKNRNQFPSILFTCIGFSTILFTAAAVMGYKMFGESTESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYAS

SEQ ID NO: 10544 - protein, 526 aa, Triticum aestivum
MLKNHISCSAYSHVSNNSFLFSLLYFDRQSIDILSNVQSPSLGFLGTPTLSRLSNSFLNSSFLNSSFRGKTPEIVSNLVKPLIRPTTSDEQQQQQQHEDIRKSSQYLLPSRKPSLQQIPEDQKPLVVGHEVSPYQQCSYTQGAMNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLNIGGLTINSHVFFAILTTLVVMPTTWLRDLTCLSYISAGGVVASILVVICLCWIGVVDHVGFENKGTALNLPGIPIAIGLYGYCYSGHGVFPNIYSSLKNRNQFPSILFTCIGFSTILFTAAAVMGYKMFGESTESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYAT

SEQ ID NO: 10545 - protein, 228 aa, Secale cereale
MNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLSIGGLTINSHVFFAILTTLVVMPTTWLRDLTCLSYISAGGVVASILVVICLCWIGVVDNVGFENKGTALNLPGIPIAIGLYGYCYSGHGVFPNIYSSLKNRNQFPSILFTCIGSLPFCLLPPR

SEQ ID NO: 10546 - protein, 497 aa, Triticum aestivum
RQSIDILSNVQSPSLGFLGTPTLSRLSNSFLNSSFLNTSFRGKTPEIVSSLVKPLIRPTTSDEQQQHEDIRKKSSQYLLPSRKPSLQQIPEDRKPVVVGHEASPYQQCSYTQGAMNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLNIGGLTINSHVFFAILTTLVVMPTTWLRDLTCLSYISAGGVVASILVVMCLCWIGVVDHVGFENKGTALNLPGIPIAIGLYGYCYSGHGVFPNIYSSLKNRNQFPSILFTCIGFSTILFTAAAVMGYKMFGEATESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYAT

SEQ ID NO: 10547 - protein, 129 aa, Secale cereale
MFCSGVGILSTPYAIKQGGWLGLVILVVFALLAWYTGVLLRRCLDSKGGPPDIPGYRPCRLWHHRSHSHLDNPVRGTVCLLHRVLDTGKRQFIQVVPKCAPEHWGLDDKLARVLRNLDDARRHADHLAP

SEQ ID NO: 10548 - protein, 566 aa, Oryza sativa
MNNSSSRYASEEERGSNSFLIESEEEEEDEEAHPHSSILLKDADSDSDSDDSSCATPRPSSYATHQWPQSYRQSIDIYSSVQSPNLSFLGTPTLSRLSNSFLTNSFRGKTPEILSNLVKPLLRPSSSSDDQQQQQQHDDDTRKSSQYLLPSRKPSLQQIPEDQKPLVPAHEVPAYQQCSYTQAVMNGINVLCGVGILSTPYAIKQGGWLGLVILCLFAVLAWYTGVLLRRCLDSKEGLETYPDIGHAAFGTTGRIAISIILYIELYACCIEYLILESDNLSKLFPNAHLTIGSMTLNSHVFFAILTTLIVMPTTWLRDLSCLSYLSAGGVIASILVVVCLCWVGVVDHVGFENKGTALNLPGIPIAIGLYGYCYSGHGVFPNIYSSLKNRNQFPSILFTCIGLSSILFAGAAVMGYKMFGESTESQFTLNLPENLVVSKVAVWTTVANPITKYALTITPLAMSLEELLPPNQQKYANIIMLRSSLVVSTLLIALSVPFFGLVMALVGSLLTMLVTYILPCACFLAILKRKVTWHQIAACSFIIVVGVCCACVGTYSSLSKIIQNYT

SEQ ID NO: 10549 - protein, 113 aa, Brachypodium distachyon
MFSTSILLQILACALYNNWWPMLAALMYILVPMPCLFFGDGSTRFLTTGEGGAWINAAKFLTGASAMGSLAIPAILRHAGLIETGAMFIEFTSFFILVCTVMCFHRATLDEDW

SEQ ID NO: 10550 - protein, 113 aa, Unknown
  Sequence found in Organisms: Sorghum bicolor, Triticum aestivum
MFSTSILLQILACALYNNWWPMLAALMYVLVPMPCLFFGGGSTHFLTSREGGGWMNAAKFLTGASAMGSLAIPAILRHAGLIETGAMFIEFTSFFILVCTVLCFHRATLDEDW

SEQ ID NO: 10551 - DNA, 2000 bp, Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 10552 - DNA, 1919 bp, Wheat LMW Longer Promoter
  misc_feature (1306)..(1316): n is a, c, g, or t
  misc_feature (1649)..(1649): n is a, c, g, or t
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 10553 - DNA, 326 bp, Wheat LMW Promoter
  misc_feature (56)..(56): n is a, c, g, or t
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 10554 - DNA, 2000 bp, Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 10555 - DNA, 425 bp, Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 10556 - DNA, 595 bp, wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 10557 - DNA, 1238 bp, wheat gamma gliadin Promoter
  misc_feature (1231)..(1231): n is a, c, g, or t
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 10558 - DNA, 2162 bp, wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 10559 - DNA, 2147 bp, wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 10560 - DNA, 1992 bp, maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 10561 - DNA, 1358 bp, Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 10562 - DNA, 1266 bp, rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 10563 - DNA, 2199 bp, rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 10564 - DNA, 1024 bp, rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 10565 - DNA, 2103 bp, arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 10566 - DNA, 901 bp, rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 10567 - DNA, 844 bp, rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 10568 - DNA, 602 bp, barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 10569 - DNA, 1729 bp, Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 10570 - DNA, 879 bp, rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 10571 - DNA, 666 bp, CaMV 35S (QFNC) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 10572 - DNA, 781 bp, PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 10573 - DNA, 877 bp, CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 10574 - DNA, 2322 bp, Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 10575 - DNA, 2318 bp, Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 10576 - DNA, 1321 bp, RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 10577 - DNA, 1599 bp, Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 10578 - DNA, 1774 bp, Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 10579 - DNA, 1127 bp, Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 10580 - DNA, 916 bp, Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 10581 - DNA, 3965 bp, Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 10582 - DNA, 4074 bp, Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 10583 - DNA, 1700 bp, Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 10584 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 10585 - DNA, 2432 bp, arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 10586 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 10587 - DNA, 31 bp, Artificial Sequence
  Primer
aaagtcgacatctcttcttcatcttcggctc

SEQ ID NO: 10588 - DNA, 27 bp, Artificial Sequence
  Primer
aaagtcgacatctcggcggcttcctac

SEQ ID NO: 10589 - DNA, 29 bp, Artificial Sequence
  Primer
aaaggatccacatcactcgggatctcctc

SEQ ID NO: 10590 - DNA, 30 bp, Artificial Sequence
  Primer
aaagtcgaccaagaaaaccagacaccatcc

SEQ ID NO: 10591 - DNA, 29 bp, Artificial Sequence
  Primer
aaactcgagcaagaagcaggatgaggagc

SEQ ID NO: 10592 - DNA, 28 bp, Artificial Sequence
  Primer
aaagtcgacagaggaaagcaggaggagg

SEQ ID NO: 10593 - DNA, 31 bp, Artificial Sequence
  Primer
aaaggatccgtgagtctcctaccctccttcc

SEQ ID NO: 10594 - DNA, 31 bp, Artificial Sequence
  Primer
aaaggatccttctggaatcacgtttcttgag

SEQ ID NO: 10595 - DNA, 34 bp, Artificial Sequence
  Primer
aaaggatccacctaatctcatcaccttctcttcc

SEQ ID NO: 10596 - DNA, 32 bp, Artificial Sequence
  Primer
aaagtcgaccagttccatggtgaagtatgttg

SEQ ID NO: 10597 - DNA, 31 bp, Artificial Sequence
  Primer
aaaggatcctcacacgtcgactaaatcaagc

SEQ ID NO: 10598 - DNA, 31 bp, Artificial Sequence
  Primer
aaaggatccttcatttcgatcgctattcctc

SEQ ID NO: 10599 - DNA, 28 bp, Artificial Sequence
  Primer
aaagtcgacgcgctagggcttaccaaac

SEQ ID NO: 10600 - DNA, 30 bp, Artificial Sequence
  Primer
aaaggatccgcctccatttcaatttcaacc

SEQ ID NO: 10601 - DNA, 29 bp, Artificial Sequence
  Primer
aaaggatccgagcagaggagtgagaagcg

SEQ ID NO: 10602 - DNA, 27 bp, Artificial Sequence
  Primer
aaaggatccagaccaatcttcggcgag

SEQ ID NO: 10603 - DNA, 28 bp, Artificial Sequence
  Primer
aaaggatcccaggcaaagcaatgaggag

SEQ ID NO: 10604 - DNA, 29 bp, Artificial Sequence
  Primer
aaagaattcccctgttggaagagttcgtg

SEQ ID NO: 10605 - DNA, 30 bp, Artificial Sequence
  Primer
aaaggatccccaggaaccaaatcgaacaac

SEQ ID NO: 10606 - DNA, 28 bp, Artificial Sequence
  Primer
aaaggatccgagacacagcttgcgaacg

SEQ ID NO: 10607 - DNA, 26 bp, Artificial Sequence
  Primer
aaagtcgaccggccatggagaccctc

SEQ ID NO: 10608 - DNA, 31 bp, Artificial Sequence
  Primer
aaaggatccgttaagcccaggtcgaagtctc

SEQ ID NO: 10609 - DNA, 27 bp, Artificial Sequence
  Primer
aaagtcgaccagccttctccctcgtcc

SEQ ID NO: 10610 - DNA, 31 bp, Artificial Sequence
  Primer
aaaggatccgggatctctctggtttcctcat

SEQ ID NO: 10611 - DNA, 28 bp, Artificial Sequence
  Primer
aaaggatcccagtcacaacggcatcaac

SEQ ID NO: 10612 - DNA, 31 bp, Artificial Sequence
  Primer
aaagtcgacctcatcgtctccatcctaaacc

SEQ ID NO: 10613 - DNA, 28 bp, Artificial Sequence
  Primer
aaaggatcccgcaaccaaccctcttctc

SEQ ID NO: 10614 - DNA, 30 bp, Artificial Sequence
  Primer
aaagtcgaccttcccgccttaagactcatc

SEQ ID NO: 10615 - DNA, 31 bp, Artificial Sequence
  Primer
aaagtcgactcttcccttaccctctcaatcg

SEQ ID NO: 10616 - DNA, 31 bp, Artificial Sequence
  Primer
aaagtcgacctcttcttttctgtccgtctcg

SEQ ID NO: 10617 - DNA, 26 bp, Artificial Sequence
  Primer
aaaggatccgcgaagcagccatgatg

SEQ ID NO: 10618 - DNA, 28 bp, Artificial Sequence
  Primer
aaaggatcccggacgataagctccaagc

SEQ ID NO: 10619 - DNA, 31 bp, Artificial Sequence
  Primer
aaagaattcatcgttcaatcgttcgagtcac

SEQ ID NO: 10620 - DNA, 26 bp, Artificial Sequence
  Primer
aaagtcgaccagccatggtgcacgtc

SEQ ID NO: 10621 - DNA, 31 bp, Artificial Sequence
  Primer
aaagtcgaccactccacactgtcaagagagg

SEQ ID NO: 10622 - DNA, 30 bp, Artificial Sequence
  Primer
aaaggatccacatctgcaggttcctttgtg

SEQ ID NO: 10623 - DNA, 27 bp, Artificial Sequence
  Primer
aaaggatcccaaaggccagcatgagct

SEQ ID NO: 10624 - DNA, 31 bp, Artificial Sequence
  Primer
aaaggatcctatttggagtagccaggaccag

SEQ ID NO: 10625 - DNA, 31 bp, Artificial Sequence
  Primer
aaaggatccccatcacattataggaggaagg

SEQ ID NO: 10626 - DNA, 31 bp, Artificial Sequence
  Primer
aaaggatccacaaagaccttcacactcgcag

SEQ ID NO: 10627 - DNA, 31 bp, Artificial Sequence
  Primer
aaaggatccggtttcaggttcatgtgttgtg

SEQ ID NO: 10628 - DNA, 28 bp, Artificial Sequence
  Primer
aaaggatcctctccattcgctatgctgg

SEQ ID NO: 10629 - DNA, 34 bp, Artificial Sequence
  Primer
aaaggatccgatgaatgaagagagagaactgcac

SEQ ID NO: 10630 - DNA, 28 bp, Artificial Sequence
  Primer
aaaggatccgccagtttcctctggcttc

SEQ ID NO: 10631 - DNA, 31 bp, Artificial Sequence
  Primer
aaaggatccttctttccgctgtagtcagtcc

SEQ ID NO: 10632 - DNA, 30 bp, Artificial Sequence
  Primer
aaagtcgacccaaaccctaaccctctttcc

SEQ ID NO: 10633 - DNA, 28 bp, Artificial Sequence
  Primer
aaaggatccggaagaaaccaagcgcaag

SEQ ID NO: 10634 - DNA, 30 bp, Artificial Sequence
  Primer
aaagtcgacggagagaagactcgaaccagc

SEQ ID NO: 10635 - DNA, 30 bp, Artificial Sequence
  Primer
aaaggatccctgacctagatcggcactctg

SEQ ID NO: 10636 - DNA, 27 bp, Artificial Sequence
  Primer
aaaggatcccgcatatgtcaggtctcg

SEQ ID NO: 10637 - DNA, 28 bp, Artificial Sequence
  Primer
aaaggatcccttctccacgtgaccacac

SEQ ID NO: 10638 - DNA, 29 bp, Artificial Sequence
  Primer
tatggatcctgaaggacaaaatggcatcc

SEQ ID NO: 10639 - DNA, 31 bp, Artificial Sequence
  Primer
aaaggatcccgactcatcgagtcattgtttg

SEQ ID NO: 10640 - DNA, 31 bp, Artificial Sequence
  Primer
aaaggatccattcaacaggttcagattgcag

SEQ ID NO: 10641 - DNA, 31 bp, Artificial Sequence
  Primer
aaaggatccactccaagagtacccaatcacc

SEQ ID NO: 10642 - DNA, 31 bp, Artificial Sequence
  Primer
aaagtcgacgcgaactcacaagagaaccaag

SEQ ID NO: 10643 - DNA, 27 bp, Artificial Sequence
  Primer
aaagaattcagcaggcgaggcagagat

SEQ ID NO: 10644 - DNA, 31 bp, Artificial Sequence
  Primer
aaaggatcctcaaactgcacacagtagcatc

SEQ ID NO: 10645 - DNA, 28 bp, Artificial Sequence
  Primer
aaaggatccgagttggagggaaggaacg

SEQ ID NO: 10646 - DNA, 31 bp, Artificial Sequence
  Primer
aaaggatcctaagtagcgtgcaaacttcgac

SEQ ID NO: 10647 - DNA, 30 bp, Artificial Sequence
  Primer
aaagtcgacccctcctgtgctttgagattc

SEQ ID NO: 10648 - DNA, 32 bp, Artificial Sequence
  Primer
aaaggatccttactccgaagattctcaagacg

SEQ ID NO: 10649 - DNA, 33 bp, Artificial Sequence
  Primer
aaactcgagtcatgagttctagaagggaagtcg

SEQ ID NO: 10650 - DNA, 31 bp, Artificial Sequence
  Primer
aaaggatccaaacacttcatcccgaagtcac

SEQ ID NO: 10651 - DNA, 37 bp, Artificial Sequence
  Primer
aaagtcgacctatggatcacgaatgatgtattgtatg

SEQ ID NO: 10652 - DNA, 31 bp, Artificial Sequence
  Primer
aaaggatccggactctggagtctgttgtctg

SEQ ID NO: 10653 - DNA, 28 bp, Artificial Sequence
  Primer
aaaggatccgagagtgggaaggggaagc

SEQ ID NO: 10654 - DNA, 31 bp, Artificial Sequence
  Primer
aaaggatccgttgttcctttgtgtccaaacc

SEQ ID NO: 10655 - DNA, 33 bp, Artificial Sequence
  Primer
aaaggatccgctggctggttatatattaggctg

SEQ ID NO: 10656 - DNA, 31 bp, Artificial Sequence
  Primer
aaagtcgactactggagtgcattaccacctg

SEQ ID NO: 10657 - DNA, 29 bp, Artificial Sequence
  Primer
aaaggatccgcgtcttgtctcgctgtacc

SEQ ID NO: 10658 - DNA, 29 bp, Artificial Sequence
  Primer
aaaggatcccgtaaaaccctagctcttgc

SEQ ID NO: 10659 - DNA, 31 bp, Artificial Sequence
  Primer
aaaggatcctggttcgctaggtttactctcc

SEQ ID NO: 10660 - DNA, 31 bp, Artificial Sequence
  Primer
aaaggatcctagtttctggcagccttcttcc

SEQ ID NO: 10661 - DNA, 27 bp, Artificial Sequence
  Primer
aaaggatccccgctgccgagaatagat

SEQ ID NO: 10662 - DNA, 29 bp, Artificial Sequence
  Primer
aaaggatccgcgctatccactcgtctctc

SEQ ID NO: 10663 - DNA, 28 bp, Artificial Sequence
  Primer
aaactcgagctgtggatcggaaatggca

SEQ ID NO: 10664 - DNA, 27 bp, Artificial Sequence
  Primer
aaaggatcccgtaggcctgacgtcacc

SEQ ID NO: 10665 - DNA, 31 bp, Artificial Sequence
  Primer
aaaggatcccacgcagtaacttgaatccctc

SEQ ID NO: 10666 - DNA, 29 bp, Artificial Sequence
  Primer
aaaggatccccaaagatcacgaaagcgac

SEQ ID NO: 10667 - DNA, 32 bp, Artificial Sequence
  Primer
aaagtcgacgtgatctgagatgagattggacc

SEQ ID NO: 10668 - DNA, 31 bp, Artificial Sequence
  Primer
aaaggatcctccgtgactgcaatagaacatc

SEQ ID NO: 10669 - DNA, 33 bp, Artificial Sequence
  Primer
aaaggatcctacaaatgccctagagctagcttc

SEQ ID NO: 10670 - DNA, 33 bp, Artificial Sequence
  Primer
aaagtcgaccacaacctgtgtacctgactaacc

SEQ ID NO: 10671 - DNA, 31 bp, Artificial Sequence
  Primer
aaagaattcgagcacatagagtggagtggtg

SEQ ID NO: 10672 - DNA, 31 bp, Artificial Sequence
  Primer
aaagtcgactcaaacttctcgatcaggttcc

SEQ ID NO: 10673 - DNA, 30 bp, Artificial Sequence
  Primer
aaaggatcccgcagttctcactccagtctc

SEQ ID NO: 10674 - DNA, 30 bp, Artificial Sequence
  Primer
aaactcgagactcccagtggccaagtacac

SEQ ID NO: 10675 - DNA, 29 bp, Artificial Sequence
  Primer
aaaggatccggacgaaggaaaaggagagg

SEQ ID NO: 10676 - DNA, 31 bp, Artificial Sequence
  Primer
aaaggatccgaatccatcacggaagaaattg

SEQ ID NO: 10677 - DNA, 28 bp, Artificial Sequence
  Primer
aaaggatccctgttcgccaccatttgtc

SEQ ID NO: 10678 - DNA, 28 bp, Artificial Sequence
  Primer
aaagtcgactctgctcttcccaagctcc

SEQ ID NO: 10679 - DNA, 27 bp, Artificial Sequence
  Primer
aaaggatccgcgagatggacgacgact

SEQ ID NO: 10680 - DNA, 31 bp, Artificial Sequence
  Primer
aaactcgagggactctccactcttcttctgc

SEQ ID NO: 10681 - DNA, 29 bp, Artificial Sequence
  Primer
aaaggatccgagacccgagaggagcaaac

SEQ ID NO: 10682 - DNA, 34 bp, Artificial Sequence
  Primer
aaaggatcccccttcacttttattcacagtttgc

SEQ ID NO: 10683 - DNA, 31 bp, Artificial Sequence
  Primer
aaagtcgacgagcgagcgagtgatgattaac

SEQ ID NO: 10684 - DNA, 28 bp, Artificial Sequence
  Primer
aaaggatcccctttcatcctcggcagtc

SEQ ID NO: 10685 - DNA, 31 bp, Artificial Sequence
  Primer
aaagtcgacactcgcagtagccagtagatgc

SEQ ID NO: 10686 - DNA, 26 bp, Artificial Sequence
  Primer
aaagtcgacgcacacgcacaagcaca

SEQ ID NO: 10687 - DNA, 27 bp, Artificial Sequence
  Primer
aaagtcgacagaagggtgggagtacgg

SEQ ID NO: 10688 - DNA, 30 bp, Artificial Sequence
  Primer
aaaggatcccctaagccaaacccaaattcc

SEQ ID NO: 10689 - DNA, 27 bp, Artificial Sequence
  Primer
aaagtcgacttaggaagaggaggccga

SEQ ID NO: 10690 - DNA, 31 bp, Artificial Sequence
  Primer
aaaggatccctgcaagctgcttatcttctcc

SEQ ID NO: 10691 - DNA, 28 bp, Artificial Sequence
  Primer
aaaggatccaaacccatttccctcgctc

SEQ ID NO: 10692 - DNA, 30 bp, Artificial Sequence
  Primer
aaaggatccaaggcaccacacctcttcttc

SEQ ID NO: 10693 - DNA, 26 bp, Artificial Sequence
  Primer
aaaggatcccgccattcatcgctacc

SEQ ID NO: 10694 - DNA, 28 bp, Artificial Sequence
  Primer
aaaggatccagacagcagaggcgagatg

SEQ ID NO: 10695 - DNA, 32 bp, Artificial Sequence
  Primer
aaagtcgacgagggagggttactaggaggttg

SEQ ID NO: 10696 - DNA, 31 bp, Artificial Sequence
  Primer
aaagtcgaccactcccactcgcataagtacc

SEQ ID NO: 10697 - DNA, 30 bp, Artificial Sequence
  Primer
aaaggatccacagcttccttcttcctctgc

SEQ ID NO: 10698 - DNA, 30 bp, Artificial Sequence
  Primer
aaaggatccagctaaccctgtccacgtctg

SEQ ID NO: 10699 - DNA, 27 bp, Artificial Sequence
  Primer
aaaggatccgctcgttctctcgcttcg

SEQ ID NO: 10700 - DNA, 28 bp, Artificial Sequence
  Primer
aaacccgggcatgtcagtgactgcagcc

SEQ ID NO: 10701 - DNA, 31 bp, Artificial Sequence
  Primer
aaaggatccattcgatgccatgtaggaagac

SEQ ID NO: 10702 - DNA, 35 bp, Artificial Sequence
  Primer
aaagtcgaccacaactactacttgccactgaagag

SEQ ID NO: 10703 - DNA, 31 bp, Artificial Sequence
  Primer
aaactcgagcttgggatttctcctcctcttg

SEQ ID NO: 10704 - DNA, 31 bp, Artificial Sequence
  Primer
aaaggatccttagtccagtggaaggtgttcg

SEQ ID NO: 10705 - DNA, 31 bp, Artificial Sequence
  Primer
aaaggatcctgcagacacaatcgttaaatcg

SEQ ID NO: 10706 - DNA, 31 bp, Artificial Sequence
  Primer
aaaggatccgtccagacaacaatatgggctt

SEQ ID NO: 10707 - DNA, 30 bp, Artificial Sequence
  Primer
aaaggatccggactctattcaggccaaaga

SEQ ID NO: 10708 - DNA, 36 bp, Artificial Sequence
  Primer
aaaggatcctgaattagtgatatcgatcagagtgtg

SEQ ID NO: 10709 - DNA, 28 bp, Artificial Sequence
  Primer
aaagtcgacccacagaaagccgaggaag

SEQ ID NO: 10710 - DNA, 31 bp, Artificial Sequence
  Primer
aaaggatccagtatcgcactcgtggaatctc

SEQ ID NO: 10711 - DNA, 34 bp, Artificial Sequence
  Primer
aaaggatccgttatccatttcttctcctctgctc

SEQ ID NO: 10712 - DNA, 30 bp, Artificial Sequence
  Primer
aaaggatccacacagagaatcaaacgctcc

SEQ ID NO: 10713 - DNA, 30 bp, Artificial Sequence
  Primer
aaaggatccaaaggaaagccaagtcgtttg

SEQ ID NO: 10714 - DNA, 28 bp, Artificial Sequence
  Primer
aaagtcgaccacgcacatcagttgaagc

SEQ ID NO: 10715 - DNA, 31 bp, Artificial Sequence
  Primer
aaaggatccgctaaacagagagcctacgacc

SEQ ID NO: 10716 - DNA, 28 bp, Artificial Sequence
  Primer
aaaggatccgtgcctggtgcttctcatc

SEQ ID NO: 10717 - DNA, 31 bp, Artificial Sequence
  Primer
aaaggatcctgtagaggtagcaagccagagc

SEQ ID NO: 10718 - DNA, 32 bp, Artificial Sequence
  Primer
aaagaattccctcacttacttcacctgtcagc

SEQ ID NO: 10719 - DNA, 25 bp, Artificial Sequence
  Primer
aaaggatccgagcctgccagccaac

SEQ ID NO: 10720 - DNA, 29 bp, Artificial Sequence
  Primer
aaagtcgaccaccgtctcctgatccaatg

SEQ ID NO: 10721 - DNA, 31 bp, Artificial Sequence
  Primer
aaaggatccaccacatggaaagtttacgctc

SEQ ID NO: 10722 - DNA, 31 bp, Artificial Sequence
  Primer
aaagtcgactgctccgggtttagataggttc

SEQ ID NO: 10723 - DNA, 29 bp, Artificial Sequence
  Primer
aaaggatcccgcaattggaacgcgtatag

SEQ ID NO: 10724 - DNA, 32 bp, Artificial Sequence
  Primer
aaaggatcctctgggcatttacatctctaagc

SEQ ID NO: 10725 - DNA, 27 bp, Artificial Sequence
  Primer
aaaggatccagcaattcgtcgagcagc

SEQ ID NO: 10726 - DNA, 30 bp, Artificial Sequence
  Primer
aaactcgagcgtatctccagctttcagacg

SEQ ID NO: 10727 - DNA, 26 bp, Artificial Sequence
  Primer
aaaggatccttcccacgatcagcgtc

SEQ ID NO: 10728 - DNA, 27 bp, Artificial Sequence
  Primer
aaagtcgaccagctcacgcacacaaca

SEQ ID NO: 10729 - DNA, 32 bp, Artificial Sequence
  Primer
aaaggatcccagtaatcactccactcctcagc

SEQ ID NO: 10730 - DNA, 29 bp, Artificial Sequence
  Primer
aaagtcgacgcgaactcccacctcctatc

SEQ ID NO: 10731 - DNA, 29 bp, Artificial Sequence
  Primer
aaaggatcccactgctccaactccattcc

SEQ ID NO: 10732 - DNA, 28 bp, Artificial Sequence
  Primer
aaaggatccggagcatggacatgaggag

SEQ ID NO: 10733 - DNA, 27 bp, Artificial Sequence
  Primer
aaaggatcctcatccggtcgttagcct

SEQ ID NO: 10734 - DNA, 29 bp, Artificial Sequence
  Primer
aaaggatccattctcgttggcttcccttc

SEQ ID NO: 10735 - DNA, 29 bp, Artificial Sequence
  Primer
aaactcgagcaatccgattccaacctcac

SEQ ID NO: 10736 - DNA, 26 bp, Artificial Sequence
  Primer
aaagtcgacaggtgctggatccgtgg

SEQ ID NO: 10737 - DNA, 28 bp, Artificial Sequence
  Primer
aaagtcgacaccgttgctggagaagagg

SEQ ID NO: 10738 - DNA, 28 bp, Artificial Sequence
  Primer
aaaggatccagggcagattctccaccac

SEQ ID NO: 10739 - DNA, 30 bp, Artificial Sequence
  Primer
aaagtcgacatggtcagattcatgctgctc

SEQ ID NO: 10740 - DNA, 31 bp, Artificial Sequence
  Primer
aaaggatccgtgtagccgagtagcagagcag

SEQ ID NO: 10741 - DNA, 31 bp, Artificial Sequence
  Primer
aaaggatccccgttctgtctacgaggtgaac

SEQ ID NO: 10742 - DNA, 31 bp, Artificial Sequence
  Primer
aaaggatccattcgcagagcagagagtgtag

SEQ ID NO: 10743 - DNA, 30 bp, Artificial Sequence
  Primer
aaagtcgacgcggataggaaactgaggaag

SEQ ID NO: 10744 - DNA, 31 bp, Artificial Sequence
  Primer
aaagtcgaccagggagcgagtctatcagatg

SEQ ID NO: 10745 - DNA, 29 bp, Artificial Sequence
  Primer
aaagtcgacgttggttgcctagacgttcg

SEQ ID NO: 10746 - DNA, 30 bp, Artificial Sequence
  Primer
aaaggatccgcggttggtatactttggttg

SEQ ID NO: 10747 - DNA, 27 bp, Artificial Sequence
  Primer
aaaggatccaagcgcacactcacggtc

SEQ ID NO: 10748 - DNA, 28 bp, Artificial Sequence
  Primer
aaaggatcctccttcctccccgtctacc

SEQ ID NO: 10749 - DNA, 31 bp, Artificial Sequence
  Primer
aaaggatccaaacaagtcaggtagcagcgtc

SEQ ID NO: 10750 - DNA, 31 bp, Artificial Sequence
  Primer
aaaggatcctgtcggaatggtcgtttaattg

SEQ ID NO: 10751 - DNA, 31 bp, Artificial Sequence
  Primer
aaaggatccgggcgtctatttgtacctgaag

SEQ ID NO: 10752 - DNA, 31 bp, Artificial Sequence
  Primer
aaaggatcctgaaaccctagccctcctaaac

SEQ ID NO: 10753 - DNA, 31 bp, Artificial Sequence
  Primer
aaactcgaggcatcctttgcattgtgtttag

SEQ ID NO: 10754 - DNA, 26 bp, Artificial Sequence
  Primer
aaagtcgacgagccaacaacccatgg

SEQ ID NO: 10755 - DNA, 31 bp, Artificial Sequence
  Primer
aaagtcgaccgtgatgatatagctggtttcg

SEQ ID NO: 10756 - DNA, 30 bp, Artificial Sequence
  Primer
aaaggatccaatcactcgtcccatttctcg

SEQ ID NO: 10757 - DNA, 29 bp, Artificial Sequence
  Primer
aaaggatccgattccatgggtcaatgacg

SEQ ID NO: 10758 - DNA, 27 bp, Artificial Sequence
  Primer
aaaggatccctctccacctccgacgac

SEQ ID NO: 10759 - DNA, 30 bp, Artificial Sequence
  Primer
aaaggatccaaccaaagcgaatttcaccac

SEQ ID NO: 10760 - DNA, 31 bp, Artificial Sequence
  Primer
aaactcgagcatcagtaaccaactcagcagg

SEQ ID NO: 10761 - DNA, 29 bp, Artificial Sequence
  Primer
aaaggatcccaccaatccggaaaggaaag

SEQ ID NO: 10762 - DNA, 29 bp, Artificial Sequence
  Primer
aaaggatcccgagcttgtcgtcctaatcc

SEQ ID NO: 10763 - DNA, 30 bp, Artificial Sequence
  Primer
aaaggatccacgcttgcactagctcatttc

SEQ ID NO: 10764 - DNA, 31 bp, Artificial Sequence
  Primer
aaagtcgacttaatcgaagcattaaacgagg

SEQ ID NO: 10765 - DNA, 31 bp, Artificial Sequence
  Primer
aaagatatcatccacagtcgctcttcttcat

SEQ ID NO: 10766 - DNA, 28 bp, Artificial Sequence
  Primer
aaagtcgaccccttcaccgtgtctctcc

SEQ ID NO: 10767 - DNA, 31 bp, Artificial Sequence
  Primer
aaaggatccagcagtagttgtggtgatggtg

SEQ ID NO: 10768 - DNA, 28 bp, Artificial Sequence
  Primer
aaagtcgacgtacgaatccgtgggaacc

SEQ ID NO: 10769 - DNA, 31 bp, Artificial Sequence
  Primer
aaagtcgacgcctactaccgagtctcaatcc

SEQ ID NO: 10770 - DNA, 30 bp, Artificial Sequence
  Primer
aaaggatcctccaaaaccctctctctgtcc

SEQ ID NO: 10771 - DNA, 29 bp, Artificial Sequence
  Primer
aaaggatcctcttctcgccatttcaccac

SEQ ID NO: 10772 - DNA, 30 bp, Artificial Sequence
  Primer
aaaggatccaagaggagccaagcggttaag

SEQ ID NO: 10773 - DNA, 31 bp, Artificial Sequence
  Primer
aaaggatccagaagtcgagaagctagggagg

SEQ ID NO: 10774 - DNA, 31 bp, Artificial Sequence
  Primer
aaaggatcctccaatcgtctatccctgactc

SEQ ID NO: 10775 - DNA, 31 bp, Artificial Sequence
  Primer
aaagtcgactgttatgctggttgaaccttcc

SEQ ID NO: 10776 - DNA, 31 bp, Artificial Sequence
  Primer
aaaggatccagtaccaccaacacgaacactc

SEQ ID NO: 10777 - DNA, 29 bp, Artificial Sequence
  Primer
aaactcgagcaaagccctccaatcttgtc

SEQ ID NO: 10778 - DNA, 30 bp, Artificial Sequence
  Primer
aaaggatcctccgactccgactccaactac

SEQ ID NO: 10779 - DNA, 29 bp, Artificial Sequence
  Primer
aaaggatccgaccaagaggcgagggatac

SEQ ID NO: 10780 - DNA, 28 bp, Artificial Sequence
  Primer
aaaggatcctcttgcttcccaccgtacc

SEQ ID NO: 10781 - DNA, 26 bp, Artificial Sequence
  Primer
aaaggatcccgtccgaatcccaatgg

SEQ ID NO: 10782 - DNA, 28 bp, Artificial Sequence
  Primer
aaaggatcccactgcaccaatcatcacg

SEQ ID NO: 10783 - DNA, 28 bp, Artificial Sequence
  Primer
aaaggatccgcaagtcacgtaccgatcg

SEQ ID NO: 10784 - DNA, 29 bp, Artificial Sequence
  Primer
aaaggatcctttgttaccctccagcatcc

SEQ ID NO: 10785 - DNA, 31 bp, Artificial Sequence
  Primer
aaaggatcctccgcttatctctcttgaaagg

SEQ ID NO: 10786 - DNA, 26 bp, Artificial Sequence
  Primer
aaagtcgacgcacggtcccttccttc

SEQ ID NO: 10787 - DNA, 28 bp, Artificial Sequence
  Primer
aaagtcgaccccactagtgccgattcag

SEQ ID NO: 10788 - DNA, 26 bp, Artificial Sequence
  Primer
aaaggatccacgtctcccctcccatg

SEQ ID NO: 10789 - DNA, 30 bp, Artificial Sequence
  Primer
aaagtcgacgtcttcactccccagcctaac

SEQ ID NO: 10790 - DNA, 30 bp, Artificial Sequence
  Primer
aaaggatccacgctagctaggcaaccaaac

SEQ ID NO: 10791 - DNA, 30 bp, Artificial Sequence
  Primer
aaaggatcccaatcaaatccaccaggaagg

SEQ ID NO: 10792 - DNA, 31 bp, Artificial Sequence
  Primer
aaaggatcccttccctcttcatcaacgtctc

SEQ ID NO: 10793 - DNA, 31 bp, Artificial Sequence
  Primer
aaaggatccgggcccacctgatcactattac

SEQ ID NO: 10794 - DNA, 29 bp, Artificial Sequence
  Primer
aaaggatccctagcttgctgcacaccttc

SEQ ID NO: 10795 - DNA, 29 bp, Artificial Sequence
  Primer
aaaggatccgacacatgacagggtggaag

SEQ ID NO: 10796 - DNA, 31 bp, Artificial Sequence
  Primer
aaaggatcccgtggcctctctcagtagaatc

SEQ ID NO: 10797 - DNA, 33 bp, Artificial Sequence
  Primer
aaagtcgacgagattctgtagcttccatgatcc

SEQ ID NO: 10798 - DNA, 34 bp, Artificial Sequence
  Primer
tttgtcgacgcttcatttgtaaatgactaaatgg

SEQ ID NO: 10799 - DNA, 31 bp, Artificial Sequence
  Primer
aaagtcgacacaaccaagaagtcgctagaag

SEQ ID NO: 10800 - DNA, 34 bp, Artificial Sequence
  Primer
aaaggatcctgaattgaattgggaaagaagtaag

SEQ ID NO: 10801 - DNA, 31 bp, Artificial Sequence
  Primer
aaaggatccttgatgaaattgcagagagtgg

SEQ ID NO: 10802 - DNA, 28 bp, Artificial Sequence
  Primer
aaagtcgacttaatcacgcgcacatcag

SEQ ID NO: 10803 - DNA, 32 bp, Artificial Sequence
  Primer
aaagtcgaccaagactcattcttcctcattcc

SEQ ID NO: 10804 - DNA, 31 bp, Artificial Sequence
  Primer
aaagtcgactaacaccacacaccattttctc

SEQ ID NO: 10805 - DNA, 32 bp, Artificial Sequence
  Primer
aaaggatcctgttccgattgtataattggtcg

SEQ ID NO: 10806 - DNA, 30 bp, Artificial Sequence
  Primer
aaaggatccttctcataaccggaaatggtg

SEQ ID NO: 10807 - DNA, 28 bp, Artificial Sequence
  Primer
aaaggatccgcattgtctccactcgctc

SEQ ID NO: 10808 - DNA, 29 bp, Artificial Sequence
  Primer
aaaggatcccgaaagaggagagagccatc

SEQ ID NO: 10809 - DNA, 28 bp, Artificial Sequence
  Primer
aaaggatccctcgagctggttgttctcc

SEQ ID NO: 10810 - DNA, 29 bp, Artificial Sequence
  Primer
aaagtcgaccattcctccgcagagtcaac

SEQ ID NO: 10811 - DNA, 32 bp, Artificial Sequence
  Primer
aaaggatccgggaataatctcctttcctcctc

SEQ ID NO: 10812 - DNA, 29 bp, Artificial Sequence
  Primer
aaaggatccgagagatgaaggaggcgacg

SEQ ID NO: 10813 - DNA, 29 bp, Artificial Sequence
  Primer
aaaggatcccctgctttctgttctgcctg

SEQ ID NO: 10814 - DNA, 27 bp, Artificial Sequence
  Primer
aaaggatccgcctggatgagctgcttc

SEQ ID NO: 10815 - DNA, 35 bp, Artificial Sequence
  Primer
tttgaattctcattagttattgccgtttttcctgc

SEQ ID NO: 10816 - DNA, 32 bp, Artificial Sequence
  Primer
tttggtaccctactgtgtcgattgaagcttgc

SEQ ID NO: 10817 - DNA, 31 bp, Artificial Sequence
  Primer
aaagaattcaagccactctacaggcaatctc

SEQ ID NO: 10818 - DNA, 31 bp, Artificial Sequence
  Primer
aaagaattctaccatcgaagccattgtaagc

SEQ ID NO: 10819 - DNA, 35 bp, Artificial Sequence
  Primer
tttaggcctttatgtatgtagggagaatcaggttg

SEQ ID NO: 10820 - DNA, 31 bp, Artificial Sequence
  Primer
aaagaattcctttacacgacctgttcagcac

SEQ ID NO: 10821 - DNA, 31 bp, Artificial Sequence
  Primer
aaaggtaccatacaggctttcaggtctccac

SEQ ID NO: 10822 - DNA, 31 bp, Artificial Sequence
  Primer
aaaggtacctctgaatctgaccgttgttgtc

SEQ ID NO: 10823 - DNA, 33 bp, Artificial Sequence
  Primer
aaaggtaccacgaagatctccatcattttatcc

SEQ ID NO: 10824 - DNA, 34 bp, Artificial Sequence
  Primer
aaagaattcctagcttgacctcacattgcataag

SEQ ID NO: 10825 - DNA, 31 bp, Artificial Sequence
  Primer
aaaggtacctatcttcttggccattctcagg

SEQ ID NO: 10826 - DNA, 32 bp, Artificial Sequence
  Primer
aaaggtaccacacaccacttgctcacatttag

SEQ ID NO: 10827 - DNA, 31 bp, Artificial Sequence
  Primer
aaaaggcctcagtacgctagagttggcagtg

SEQ ID NO: 10828 - DNA, 34 bp, Artificial Sequence
  Primer
tttggtaccttactcatgatcctgatgctgaaca

SEQ ID NO: 10829 - DNA, 34 bp, Artificial Sequence
  Primer
tttggtaccttactcaaggatatgcacaaagctg

SEQ ID NO: 10830 - DNA, 31 bp, Artificial Sequence
  Primer
aaaggtacccttgtcaggtttcagcaatcag

SEQ ID NO: 10831 - DNA, 31 bp, Artificial Sequence
  Primer
aaaggtaccaattgtggcttagttgtggctc

SEQ ID NO: 10832 - DNA, 31 bp, Artificial Sequence
  Primer
aaaaggcctaagtggatcattcaaagcaacc

SEQ ID NO: 10833 - DNA, 36 bp, Artificial Sequence
  Primer
tttggtacctcagttagaacccgaatgtaccttgct

SEQ ID NO: 10834 - DNA, 34 bp, Artificial Sequence
  Primer
aaaggtaccctataggccgagcatagcatagaag

SEQ ID NO: 10835 - DNA, 35 bp, Artificial Sequence
  Primer
tttggatccgcattgatctctctctgttcacttct

SEQ ID NO: 10836 - DNA, 31 bp, Artificial Sequence
  Primer
aaaggtaccgggaatcatgacacagtaatcg

SEQ ID NO: 10837 - DNA, 31 bp, Artificial Sequence
  Primer
aaagaattctgtgccaaaatgttcttagtcg

SEQ ID NO: 10838 - DNA, 31 bp, Artificial Sequence
  Primer
aaaggtacccgagtggtgatcgtttactcag

SEQ ID NO: 10839 - DNA, 31 bp, Artificial Sequence
  Primer
aaaggtacctggttgaaaccaaagttcaaag

SEQ ID NO: 10840 - DNA, 31 bp, Artificial Sequence
  Primer
aaaggatcctctcttgagaaatgccagacag

SEQ ID NO: 10841 - DNA, 30 bp, Artificial Sequence
  Primer
aaaggtaccattggagctgacatttgttgg

SEQ ID NO: 10842 - DNA, 31 bp, Artificial Sequence
  Primer
aaagaattcacaccgaactttgtttctttcg

SEQ ID NO: 10843 - DNA, 31 bp, Artificial Sequence
  Primer
aaagaattccccatccaaaccagaggtaaac

SEQ ID NO: 10844 - DNA, 31 bp, Artificial Sequence
  Primer
aaaggatcccaagaacatcgtgcgataaaac

SEQ ID NO: 10845 - DNA, 34 bp, Artificial Sequence
  Primer
aaaggtaccctactcatgtggcattacaaccaac

SEQ ID NO: 10846 - DNA, 31 bp, Artificial Sequence
  Primer
aaaggtaccactcatcaaccattgcacacac

SEQ ID NO: 10847 - DNA, 31 bp, Artificial Sequence
  Primer
tttaggcctaggtcgatacaacattcaggtg

SEQ ID NO: 10848 - DNA, 31 bp, Artificial Sequence
  Primer
aaagaattcaacatctgtgacaccgaatcag

SEQ ID NO: 10849 - DNA, 31 bp, Artificial Sequence
  Primer
aaagaattcaaccggtatcttgtcatgttgc

SEQ ID NO: 10850 - DNA, 31 bp, Artificial Sequence
  Primer
aaaggtaccgcacactcttattctgacgacg

SEQ ID NO: 10851 - DNA, 31 bp, Artificial Sequence
  Primer
tttgaattcttacgcagccagttagtgcttg

SEQ ID NO: 10852 - DNA, 31 bp, Artificial Sequence
  Primer
aaaggtaccaatcagcgggtttctttactgc

SEQ ID NO: 10853 - DNA, 33 bp, Artificial Sequence
  Primer
aaaggtaccctacatgacatactctcgcacaag

SEQ ID NO: 10854 - DNA, 31 bp, Artificial Sequence
  Primer
aaaggtacctacattgtcacagtgctgatgg

SEQ ID NO: 10855 - DNA, 31 bp, Artificial Sequence
  Primer
aaaggtacccagctccttgtggctactgaac

SEQ ID NO: 10856 - DNA, 31 bp, Artificial Sequence
  Primer
aaaggtaccaaaggtgagattcaaaggctcc

SEQ ID NO: 10857 - DNA, 32 bp, Artificial Sequence
  Primer
aaaggtaccaagctgaagctggactagcctac

SEQ ID NO: 10858 - DNA, 31 bp, Artificial Sequence
  Primer
aaaggtacctacacacaatgcgatgtgactg

SEQ ID NO: 10859 - DNA, 31 bp, Artificial Sequence
  Primer
aaaggtaccaagcaagagtgtggtgtacgtg

SEQ ID NO: 10860 - DNA, 35 bp, Artificial Sequence
  Primer
tttgaattccaaaactaactgatttaagtggcctt

SEQ ID NO: 10861 - DNA, 31 bp, Artificial Sequence
  Primer
aaaggtacctcactgaatcctggtacagcac

SEQ ID NO: 10862 - DNA, 31 bp, Artificial Sequence
  Primer
aaaggatccgtgggtgaaccaacaaactacc

SEQ ID NO: 10863 - DNA, 31 bp, Artificial Sequence
  Primer
aaaggtacccaaagttcagtgcatttcccag

SEQ ID NO: 10864 - DNA, 29 bp, Artificial Sequence
  Primer
aaaggtacccaactacagtgaggatcgca

SEQ ID NO: 10865 - DNA, 31 bp, Artificial Sequence
  Primer
aaaggtacctcagtgctcaatagtcaccagc

SEQ ID NO: 10866 - DNA, 31 bp, Artificial Sequence
  Primer
aaaggtaccagcaagggtgagcttgtatcac

SEQ ID NO: 10867 - DNA, 31 bp, Artificial Sequence
  Primer
aaaggtacccgtgcaacttggagatatgaac

SEQ ID NO: 10868 - DNA, 31 bp, Artificial Sequence
  Primer
aaaggtacccagttgaagctgctgacagaac

SEQ ID NO: 10869 - DNA, 31 bp, Artificial Sequence
  Primer
aaaggtaccaagccagactgaatcaacgaag

SEQ ID NO: 10870 - DNA, 31 bp, Artificial Sequence
  Primer
aaagaattccgccagtgatatggtcaagtag

SEQ ID NO: 10871 - DNA, 31 bp, Artificial Sequence
  Primer
aaaaggcctcggttcaaagaaatcaggaatg

SEQ ID NO: 10872 - DNA, 31 bp, Artificial Sequence
  Primer
aaaggtaccttcatatgcttccacagctcac

SEQ ID NO: 10873 - DNA, 37 bp, Artificial Sequence
  Primer
ttaggtaccttactagctagatacgtacgtccaccac

SEQ ID NO: 10874 - DNA, 30 bp, Artificial Sequence
  Primer
aaaggtaccaaatgacaatggagtcccagg

SEQ ID NO: 10875 - DNA, 34 bp, Artificial Sequence
  Primer
aaaggatccctaaacacacgagttggaaggaaac

SEQ ID NO: 10876 - DNA, 34 bp, Artificial Sequence
  Primer
aaaggtaccctatagcaacactgaaccaaattcc

SEQ ID NO: 10877 - DNA, 34 bp, Artificial Sequence
  Primer
aaagaattcctaagaattgaggttcacaagcacc

SEQ ID NO: 10878 - DNA, 33 bp, Artificial Sequence
  Primer
aaaggtaccctatgtatgagcagacagcagagc

SEQ ID NO: 10879 - DNA, 33 bp, Artificial Sequence
  Primer
tttggtaccgcacagcataactaatttggcact

SEQ ID NO: 10880 - DNA, 35 bp, Artificial Sequence
  Primer
tatggtaccttaactctatttcttgctgcgaccac

SEQ ID NO: 10881 - DNA, 29 bp, Artificial Sequence
  Primer
tttgaattcgcatgatcaggcccatctac

SEQ ID NO: 10882 - DNA, 35 bp, Artificial Sequence
  Primer
aaaggtaccctatatgcttgtgtatgaggacggag

SEQ ID NO: 10883 - DNA, 31 bp, Artificial Sequence
  Primer
aaaggtacctaaatttctcatcggcaactcg

SEQ ID NO: 10884 - DNA, 31 bp, Artificial Sequence
  Primer
aaagaattcttgccttccaatacaatcaagg

SEQ ID NO: 10885 - DNA, 30 bp, Artificial Sequence
  Primer
aaaggtacccgcttctgatgaagtccaatc

SEQ ID NO: 10886 - DNA, 34 bp, Artificial Sequence
  Primer
aaaggtaccctaaattccgaacaaactaccacac

SEQ ID NO: 10887 - DNA, 31 bp, Artificial Sequence
  Primer
ataggtaccagtcttgtccgtcatgctacca

SEQ ID NO: 10888 - DNA, 31 bp, Artificial Sequence
  Primer
aaaggtaccaatttacatgacgagcctggac

SEQ ID NO: 10889 - DNA, 31 bp, Artificial Sequence
  Primer
aaaggtaccttcaagaaaccaaccaaccaat

SEQ ID NO: 10890 - DNA, 31 bp, Artificial Sequence
  Primer
aaaggtacctgctctgggaattctgcaatac

SEQ ID NO: 10891 - DNA, 29 bp, Artificial Sequence
  Primer
tttgaattcttattggtgagcgtccatcg

SEQ ID NO: 10892 - DNA, 31 bp, Artificial Sequence
  Primer
aaagaattcactggaagcaacaaactccaag

SEQ ID NO: 10893 - DNA, 31 bp, Artificial Sequence
  Primer
aaaggtacctacaaatgcagaattagcccac

SEQ ID NO: 10894 - DNA, 34 bp, Artificial Sequence
  Primer
aaaggtaccctagctatttaagctggtttgccac

SEQ ID NO: 10895 - DNA, 31 bp, Artificial Sequence
  Primer
aaaggatccgctgtcaaggcaagtacacaag

SEQ ID NO: 10896 - DNA, 31 bp, Artificial Sequence
  Primer
aaaggtaccgacatccaacacaattgagagc

SEQ ID NO: 10897 - DNA, 32 bp, Artificial Sequence
  Primer
aaaggtaccgtattacatgaaccaaactccgg

SEQ ID NO: 10898 - DNA, 31 bp, Artificial Sequence
  Primer
aaagaattcgggagaaacaatctacagccag

SEQ ID NO: 10899 - DNA, 30 bp, Artificial Sequence
  Primer
tttaggcctcgaacttggggtctgataaca

SEQ ID NO: 10900 - DNA, 31 bp, Artificial Sequence
  Primer
aaaaggcctagcagcccagtcacaaacttac

SEQ ID NO: 10901 - DNA, 31 bp, Artificial Sequence
  Primer
aaaggtaccctaatacctagccacgccaacg

SEQ ID NO: 10902 - DNA, 31 bp, Artificial Sequence
  Primer
aaagagctcacgcagtagtagccaagagtcg

SEQ ID NO: 10903 - DNA, 33 bp, Artificial Sequence
  Primer
tttggtaccaccagaacatctaaaagctagctg

SEQ ID NO: 10904 - DNA, 35 bp, Artificial Sequence
  Primer
aaaggtaccctatccatatcgagagagttcacagg

SEQ ID NO: 10905 - DNA, 29 bp, Artificial Sequence
  Primer
aaaggtaccggacagaaagcttaggcagc

SEQ ID NO: 10906 - DNA, 31 bp, Artificial Sequence
  Primer
aaagaattcactgaaaccactacgcaagtcc

SEQ ID NO: 10907 - DNA, 30 bp, Artificial Sequence
  Primer
tttggtaccgatcacacatctcacaggtgc

SEQ ID NO: 10908 - DNA, 32 bp, Artificial Sequence
  Primer
aaagaattcatttctgatggacatggtgtacg

SEQ ID NO: 10909 - DNA, 31 bp, Artificial Sequence
  Primer
aaaggtaccacgggatacaaacagacagacc

SEQ ID NO: 10910 - DNA, 37 bp, Artificial Sequence
  Primer
tttggtaccctacttctaccaggtggatatcttcatg

SEQ ID NO: 10911 - DNA, 32 bp, Artificial Sequence
  Primer
aaaaggcctcactccatgcaagtatgaaatcc

SEQ ID NO: 10912 - DNA, 31 bp, Artificial Sequence
  Primer
aaaggtaccttcagcgtcaacaactagcatc

SEQ ID NO: 10913 - DNA, 31 bp, Artificial Sequence
  Primer
aaaggatcccaaactttggctccagaatcag

SEQ ID NO: 10914 - DNA, 28 bp, Artificial Sequence
  Primer
tttgaattcggaggacccagacagtgaa

SEQ ID NO: 10915 - DNA, 31 bp, Artificial Sequence
  Primer
aaagaattccagagtttacagggctgaaagg

SEQ ID NO: 10916 - DNA, 35 bp, Artificial Sequence
  Primer
aaaggtaccctaacagcaaagcacaactaacttgg

SEQ ID NO: 10917 - DNA, 31 bp, Artificial Sequence
  Primer
aaaggatcccctcagcaaggaaatgctagac

SEQ ID NO: 10918 - DNA, 31 bp, Artificial Sequence
  Primer
aaagaattcactacagccggtgctttacttg

SEQ ID NO: 10919 - DNA, 31 bp, Artificial Sequence
  Primer
aaaggtaccatatatagcaggagcaccgcac

SEQ ID NO: 10920 - DNA, 30 bp, Artificial Sequence
  Primer
tttggtaccgggtgcagttgacaggatctt

SEQ ID NO: 10921 - DNA, 40 bp, Artificial Sequence
  Primer
tttgaattcgagataaatataaaacgaactaaggatcgtc

SEQ ID NO: 10922 - DNA, 32 bp, Artificial Sequence
  Primer
aaaggtaccctaaacagtttcagcatggatgg

SEQ ID NO: 10923 - DNA, 31 bp, Artificial Sequence
  Primer
aaaaggcctcgttaccgctgctatacaaacc

SEQ ID NO: 10924 - DNA, 32 bp, Artificial Sequence
  Primer
aaaggatcctactcatgtggaacgaccatttc

SEQ ID NO: 10925 - DNA, 31 bp, Artificial Sequence
  Primer
aaaggtacccggctgttctaatcctgtcatc

SEQ ID NO: 10926 - DNA, 34 bp, Artificial Sequence
  Primer
aaaggtaccctacatcctggaatgatgactgaac

SEQ ID NO: 10927 - DNA, 31 bp, Artificial Sequence
  Primer
aaaggtaccatgaacaggcttctttggtttc

SEQ ID NO: 10928 - DNA, 31 bp, Artificial Sequence
  Primer
aaaggtaccgaaacttgcccacctttatctg

SEQ ID NO: 10929 - DNA, 31 bp, Artificial Sequence
  Primer
aaaggtacccattggagcatcagaatgtacg

SEQ ID NO: 10930 - DNA, 31 bp, Artificial Sequence
  Primer
aaagatatcggagcagagaccatcgtctaac

SEQ ID NO: 10931 - DNA, 35 bp, Artificial Sequence
  Primer
aaagaattcctatcctacttcaggtttctgcattg

SEQ ID NO: 10932 - DNA, 31 bp, Artificial Sequence
  Primer
aaaggtaccccatgtataccacggaaggaag

SEQ ID NO: 10933 - DNA, 31 bp, Artificial Sequence
  Primer
aaaggtaccattaaccggccatacacatgac

SEQ ID NO: 10934 - DNA, 30 bp, Artificial Sequence
  Primer
aaaggtacccgaagacttgaattcccatga

SEQ ID NO: 10935 - DNA, 31 bp, Artificial Sequence
  Primer
aaaggtacccgttcacgtgcttcagactaac

SEQ ID NO: 10936 - DNA, 31 bp, Artificial Sequence
  Primer
aaaggtaccagaaagcatttcacaccaaagg

SEQ ID NO: 10937 - DNA, 31 bp, Artificial Sequence
  Primer
aaagaattcccataggatcattcatcgtgag

SEQ ID NO: 10938 - DNA, 31 bp, Artificial Sequence
  Primer
aaaggtaccaatggtcaggtcccagtacaac

SEQ ID NO: 10939 - DNA, 32 bp, Artificial Sequence
  Primer
aaaggtacccaactgtttgcagaacaacagac

SEQ ID NO: 10940 - DNA, 31 bp, Artificial Sequence
  Primer
aaaggtaccaagatggacgccaacataacac

SEQ ID NO: 10941 - DNA, 31 bp, Artificial Sequence
  Primer
aaaggtaccaaacaaggctaatccaccactg

SEQ ID NO: 10942 - DNA, 31 bp, Artificial Sequence
  Primer
aaaggtacctgactttctcctccaccaaatg

SEQ ID NO: 10943 - DNA, 32 bp, Artificial Sequence
  Primer
aaaggtaccccgacagaattatatgcatttgg

SEQ ID NO: 10944 - DNA, 31 bp, Artificial Sequence
  Primer
aaaggtaccggtcacttaactcagcacatgg

SEQ ID NO: 10945 - DNA, 31 bp, Artificial Sequence
  Primer
aaaggtacccacaccatgaataacgaacacc

SEQ ID NO: 10946 - DNA, 29 bp, Artificial Sequence
  Primer
aaaaggcctattgattgatgccatgctcc

SEQ ID NO: 10947 - DNA, 30 bp, Artificial Sequence
  Primer
tttggtacccgcagcaacgttacacaagag

SEQ ID NO: 10948 - DNA, 31 bp, Artificial Sequence
  Primer
aaagaattcagatcgaacccagctaggaaag

SEQ ID NO: 10949 - DNA, 30 bp, Artificial Sequence
  Primer
aaaggtacctgctctaggaacagttcgtgc

SEQ ID NO: 10950 - DNA, 31 bp, Artificial Sequence
  Primer
aaaaggcctagggcgagatcaggaactttac

SEQ ID NO: 10951 - DNA, 31 bp, Artificial Sequence
  Primer
aaaggtaccaagttccctgcacgatttacag

SEQ ID NO: 10952 - DNA, 31 bp, Artificial Sequence
  Primer
aaaggtacctaaccctcaggtgcattagacc

SEQ ID NO: 10953 - DNA, 31 bp, Artificial Sequence
  Primer
aaaggtaccagaaccaatgtaaccaggcatc

SEQ ID NO: 10954 - DNA, 31 bp, Artificial Sequence
  Primer
aaagaattcgaagccacgctaatcatactcc

SEQ ID NO: 10955 - DNA, 35 bp, Artificial Sequence
  Primer
aaaggtacctgccgtttacaatacagatttattcc

SEQ ID NO: 10956 - DNA, 31 bp, Artificial Sequence
  Primer
aaaggatccctctgttctagcaggagccaac

SEQ ID NO: 10957 - DNA, 33 bp, Artificial Sequence
  Primer
aaagaattcctagacaaatgtagcagcagccag

SEQ ID NO: 10958 - DNA, 31 bp, Artificial Sequence
  Primer
aaaggatccgaccaacccagcatatcaagag

SEQ ID NO: 10959 - DNA, 31 bp, Artificial Sequence
  Primer
aaaggtacccatttgtttccacatcatctcg

SEQ ID NO: 10960 - DNA, 36 bp, Artificial Sequence
  Primer
tttggtaccctagtgttggagttgctctaagaggac

SEQ ID NO: 10961 - DNA, 33 bp, Artificial Sequence
  Primer
tttgatatctcatgttccctaccatctctcgtc

SEQ ID NO: 10962 - DNA, 36 bp, Artificial Sequence
  Primer
aaaggtaccgctaatgagaagagctcaagaacaaag

SEQ ID NO: 10963 - DNA, 31 bp, Artificial Sequence
  Primer
aaaaggcctgctgtacatgttcctcggtatg

SEQ ID NO: 10964 - DNA, 31 bp, Artificial Sequence
  Primer
aaagaattctacgaagcatctaacccgactc

SEQ ID NO: 10965 - DNA, 31 bp, Artificial Sequence
  Primer
aaagaattctagagcgaatgcagaaacacag

SEQ ID NO: 10966 - DNA, 31 bp, Artificial Sequence
  Primer
aaaggtacctggtctgagaaatgaactgctg

SEQ ID NO: 10967 - DNA, 31 bp, Artificial Sequence
  Primer
aaagaattcagatgatgcgtcacaaactcac

SEQ ID NO: 10968 - DNA, 32 bp, Artificial Sequence
  Primer
tttggtaccgcgacactatgagttacgagcac

SEQ ID NO: 10969 - DNA, 31 bp, Artificial Sequence
  Primer
aaaggtaccaatacatgcgctacacaattcg

SEQ ID NO: 10970 - DNA, 31 bp, Artificial Sequence
  Primer
aaaggtaccgcctcgtaacacttctggaaac

SEQ ID NO: 10971 - DNA, 31 bp, Artificial Sequence
  Primer
aaagaattcatcaaggctcgacttatcatgc

SEQ ID NO: 10972 - DNA, 31 bp, Artificial Sequence
  Primer
aaaggatccactgcaacatctgcaaacaaag

SEQ ID NO: 10973 - DNA, 31 bp, Artificial Sequence
  Primer
aaaaggcctggagcacgactctacaaacacc

SEQ ID NO: 10974 - DNA, 31 bp, Artificial Sequence
  Primer
aaagaattcatgccaatttgggaactcatag

SEQ ID NO: 10975 - DNA, 32 bp, Artificial Sequence
  Primer
aaaggtaccggctccatatgaacaaacacaag

SEQ ID NO: 10976 - DNA, 31 bp, Artificial Sequence
  Primer
tttggtaccccagaggacaaaggaatatcgc

SEQ ID NO: 10977 - DNA, 31 bp, Artificial Sequence
  Primer
aaaggtaccggattaacgcaggacagagatg

SEQ ID NO: 10978 - DNA, 32 bp, Artificial Sequence
  Primer
aaagaattctgaagcaagcaacttcatctagc

SEQ ID NO: 10979 - DNA, 34 bp, Artificial Sequence
  Primer
aaaggtaccctataaacctccaactgtatcgctg

SEQ ID NO: 10980 - DNA, 31 bp, Artificial Sequence
  Primer
aaaggtaccccggaaatcgtctatttgtctg

SEQ ID NO: 10981 - DNA, 34 bp, Artificial Sequence
  Primer
aaaaggcctctaagctagcagccggatgatatag

SEQ ID NO: 10982 - DNA, 31 bp, Artificial Sequence
  Primer
aaagaattcatcaggatatgtacagccgtgg

SEQ ID NO: 10983 - DNA, 31 bp, Artificial Sequence
  Primer
aaagaattcttcacagtacacgtccggatag

SEQ ID NO: 10984 - DNA, 31 bp, Artificial Sequence
  Primer
aaaggtacctctggctatgcacacaactttc

SEQ ID NO: 10985 - DNA, 39 bp, Artificial Sequence
  Primer
aaaggtaccttacgaaccacactagtatttagacgtgag

SEQ ID NO: 10986 - DNA, 30 bp, Artificial Sequence
  Primer
aaaggtacctcctcattcactcagctggac

SEQ ID NO: 10987 - DNA, 31 bp, Artificial Sequence
  Primer
aaaggtacccagtctgccgaactttatgagc

SEQ ID NO: 10988 - DNA, 31 bp, Artificial Sequence
  Primer
aaagaattcgggacatggatagcgaaactac

SEQ ID NO: 10989 - DNA, 29 bp, Artificial Sequence
  Primer
tttggtaccttaacccggaaggtctcacg

SEQ ID NO: 10990 - DNA, 31 bp, Artificial Sequence
  Primer
aaaggtacctagtagtcgctggttgttgagg

SEQ ID NO: 10991 - DNA, 31 bp, Artificial Sequence
  Primer
aaaggtaccccatgagcaattagcaacacag

SEQ ID NO: 10992 - DNA, 30 bp, Artificial Sequence
  Primer
aaaggatccataacacattcaagtgcggag

SEQ ID NO: 10993 - DNA, 31 bp, Artificial Sequence
  Primer
aaactcgagctaaacacagcagtggatcgga

SEQ ID NO: 10994 - DNA, 33 bp, Artificial Sequence
  Primer
aaagaattcctaggtaacagtaagctcggcctg

SEQ ID NO: 10995 - DNA, 31 bp, Artificial Sequence
  Primer
aaaggtacctacattggttccagaactgagc

SEQ ID NO: 10996 - DNA, 30 bp, Artificial Sequence
  Primer
aaaggatcccagtacaatgccaccttcgac

SEQ ID NO: 10997 - DNA, 31 bp, Artificial Sequence
  Primer
aaagaattccaacagatgtatgtccggtctg

SEQ ID NO: 10998 - DNA, 34 bp, Artificial Sequence
  Primer
aaaggtacctcaagtagagaaccaacagggatgc

SEQ ID NO: 10999 - DNA, 32 bp, Artificial Sequence
  Primer
aaaggtacccaaacacaagggatgtcattctc

SEQ ID NO: 11000 - DNA, 32 bp, Artificial Sequence
  Primer
aaaggtaccctgtcgtcagtcagttgtttcac

SEQ ID NO: 11001 - DNA, 31 bp, Artificial Sequence
  Primer
aaaggtaccgaagtaccatgagtcccagagg

SEQ ID NO: 11002 - DNA, 31 bp, Artificial Sequence
  Primer
aaaggtaccaatgcaagcgaaggcataatag

SEQ ID NO: 11003 - DNA, 33 bp, Artificial Sequence
  Primer
aaaaggcctaacaggaaatgaacaggtcgtaac

SEQ ID NO: 11004 - DNA, 31 bp, Artificial Sequence
  Primer
aaaggtaccaatgcacacaggagtacacgac

SEQ ID NO: 11005 - DNA, 31 bp, Artificial Sequence
  Primer
aaaaggccttgcagcacgaaagtagcatatc

SEQ ID NO: 11006 - DNA, 34 bp, Artificial Sequence
  Primer
aaaggtaccctaatagaatgacgagcaatccagc

SEQ ID NO: 11007 - DNA, 33 bp, Artificial Sequence
  Primer
aaaggtaccgtactacaaagctaagcctccacg

SEQ ID NO: 11008 - DNA, 31 bp, Artificial Sequence
  Primer
aaaggtacctagtcatatgctgccactgagc

SEQ ID NO: 11009 - DNA, 31 bp, Artificial Sequence
  Primer
aaaggtacccttacatttagagcggctgacg

SEQ ID NO: 11010 - DNA, 31 bp, Artificial Sequence
  Primer
aaaggtaccccacaagatctagaggccattc

SEQ ID NO: 11011 - DNA, 34 bp, Artificial Sequence
  Primer
aaaggtacccgagaaattattccatctcacttgc

SEQ ID NO: 11012 - DNA, 30 bp, Artificial Sequence
  Primer
aaaggtaccgatcaaattcccgctcaaatc

SEQ ID NO: 11013 - DNA, 31 bp, Artificial Sequence
  Primer
aaaggtacccgtacgtatttcccagcttctg

SEQ ID NO: 11014 - DNA, 30 bp, Artificial Sequence
  Primer
tttgtcgactcatcttgctcaacccagctc

SEQ ID NO: 11015 - DNA, 32 bp, Artificial Sequence
  Primer
tttggatcccagcctcacactagttatcgctc

SEQ ID NO: 11016 - DNA, 33 bp, Artificial Sequence
  Primer
tttggtacccagtaggagtagcagtagatgccg

SEQ ID NO: 11017 - DNA, 33 bp, Artificial Sequence
  Primer
tttggatccctcaatccagcaccataagatctc

SEQ ID NO: 11018 - DNA, 31 bp, Artificial Sequence
  Primer
aaaggtacctaactgaaacgaaaccatgctg

SEQ ID NO: 11019 - DNA, 31 bp, Artificial Sequence
  Primer
aaaggtaccgtcaccacttcactggaatcag

SEQ ID NO: 11020 - DNA, 31 bp, Artificial Sequence
  Primer
aaaggtaccagccaaaccctgcctaactaac

SEQ ID NO: 11021 - DNA, 31 bp, Artificial Sequence
  Primer
aaaggtaccgttcaaagaatgtggtggcttc

SEQ ID NO: 11022 - DNA, 30 bp, Artificial Sequence
  Primer
aaaggtacctcggctctcaaagtacacagc

SEQ ID NO: 11023 - DNA, 35 bp, Artificial Sequence
  Primer
tttggtaccttaatgaagatgaacagcagaggaac

SEQ ID NO: 11024 - DNA, 31 bp, Artificial Sequence
  Primer
aaaggtaccaagaagtcacgtcgaaccaaac

SEQ ID NO: 11025 - DNA, 35 bp, Artificial Sequence
  Primer
aaaggatccggcgccttatctttactttcattaag

SEQ ID NO: 11026 - DNA, 40 bp, Artificial Sequence
  Primer
tttgaattcgcaaacaagtaactatacaataaacaagtac

SEQ ID NO: 11027 - DNA, 31 bp, Artificial Sequence
  Primer
aaaaggcctcacaaatttcaggatcttgtcc

SEQ ID NO: 11028 - DNA, 31 bp, Artificial Sequence
  Primer
aaaggtacctgaagaatttatgaagggcgag

SEQ ID NO: 11029 - DNA, 31 bp, Artificial Sequence
  Primer
aaaggtaccatttctttggaaagggaggatg

SEQ ID NO: 11030 - DNA, 32 bp, Artificial Sequence
  Primer
aaaggatccgtgtgaaatgaagattcagcagg

SEQ ID NO: 11031 - DNA, 33 bp, Artificial Sequence
  Primer
aaaggatccctaaacaaacagaaggaaggcagc

SEQ ID NO: 11032 - DNA, 31 bp, Artificial Sequence
  Primer
aaagaattccaagttacgactacgatgcttg

SEQ ID NO: 11033 - DNA, 34 bp, Artificial Sequence
  Primer
aaaggtacctcattggagacactgtacaacagac

SEQ ID NO: 11034 - DNA, 33 bp, Artificial Sequence
  Primer
aaaggtacctcaaagaatccagaaacttcacac

SEQ ID NO: 11035 - DNA, 31 bp, Artificial Sequence
  Primer
aaaggtaccggagagatcctggtatcgaagc

SEQ ID NO: 11036 - DNA, 33 bp, Artificial Sequence
  Primer
aaaggtaccctaacacagtacggcaggagacac

SEQ ID NO: 11037 - DNA, 31 bp, Artificial Sequence
  Primer
aaaggtacccaatcttcctttgctggagttc

SEQ ID NO: 11038 - DNA, 34 bp, Artificial Sequence
  Primer
aaaggatccctatgcagaatgaatctcaaagctg

SEQ ID NO: 11039 - DNA, 31 bp, Artificial Sequence
  Primer
aaaggtaccagctagagccatgcataacagc

SEQ ID NO: 11040 - DNA, 32 bp, Artificial Sequence
  Primer
tttggtaccggtacatttgacacctgcctgac

SEQ ID NO: 11041 - DNA, 31 bp, Artificial Sequence
  Primer
aaaggtaccatgagtgaaatcaaccaggagc

SEQ ID NO: 11042 - DNA, 31 bp, Artificial Sequence
  Primer
aaaggtaccaaagaccgtgttcctaaacctg

SEQ ID NO: 11043 - DNA, 31 bp, Artificial Sequence
  Primer
aaaggatcccagaagtatcgcggaaactgac

SEQ ID NO: 11044 - DNA, 32 bp, Artificial Sequence
  Primer
aaaggatccgtctgttgcatgcctaaactagg

SEQ ID NO: 11045 - DNA, 32 bp, Artificial Sequence
  Primer
aaagtcgactgtgttcaaccatatgagctctg

SEQ ID NO: 11046 - DNA, 31 bp, Artificial Sequence
  Primer
aaaggatccctctctctccgaacgaaatcac

SEQ ID NO: 11047 - DNA, 31 bp, Artificial Sequence
  Primer
aaaggatcctctgtggcaatttgtgtctttc

SEQ ID NO: 11048 - DNA, 28 bp, Artificial Sequence
  Primer
aaagtcgactggtgattcttgctgcctg

SEQ ID NO: 11049 - DNA, 26 bp, Artificial Sequence
  Primer
ttaggatcctttccgatggcctccac

SEQ ID NO: 11050 - DNA, 29 bp, Artificial Sequence
  Primer
aaaggatccctagctttacctccgccacc

SEQ ID NO: 11051 - DNA, 27 bp, Artificial Sequence
  Primer
aaagtcgactctccctcgtccatcacc

SEQ ID NO: 11052 - DNA, 30 bp, Artificial Sequence
  Primer
aaaggatccgcatcaaccctctccttatcc

SEQ ID NO: 11053 - DNA, 30 bp, Artificial Sequence
  Primer
aaaggatccccacgagctcaaatctcaatc

SEQ ID NO: 11054 - DNA, 29 bp, Artificial Sequence
  Primer
aaagtcgacgccttaagactcatccgtgc

SEQ ID NO: 11055 - DNA, 31 bp, Artificial Sequence
  Primer
aaagtcgactctcaatcgagactgcaacaac

SEQ ID NO: 11056 - DNA, 29 bp, Artificial Sequence
  Primer
aaaggatccacgataagctccaagcgacc

SEQ ID NO: 11057 - DNA, 31 bp, Artificial Sequence
  Primer
aaagaattcacgccatacaacacggatagag

SEQ ID NO: 11058 - DNA, 31 bp, Artificial Sequence
  Primer
aaaggatcctctcatctcctgccatatcgtc

SEQ ID NO: 11059 - DNA, 31 bp, Artificial Sequence
  Primer
aaaggatccaaattaacggaagcggtttctc

SEQ ID NO: 11060 - DNA, 26 bp, Artificial Sequence
  Primer
aaaggatccccctccccaagcaattc

SEQ ID NO: 11061 - DNA, 29 bp, Artificial Sequence
  Primer
aaaggatccgtgttccgtgttccaactcc

SEQ ID NO: 11062 - DNA, 31 bp, Artificial Sequence
  Primer
aaaggatcccattgtttgtcctcatccatcc

SEQ ID NO: 11063 - DNA, 29 bp, Artificial Sequence
  Primer
aaaggatcctttcctcggagctcagttcc

SEQ ID NO: 11064 - DNA, 31 bp, Artificial Sequence
  Primer
aaaggatcctaacaaaggatttggaacccag

SEQ ID NO: 11065 - DNA, 35 bp, Artificial Sequence
  Primer
aaagtcgaccacgaatgatgtattgtatgcaattc

SEQ ID NO: 11066 - DNA, 31 bp, Artificial Sequence
  Primer
aaaggatcccctcacattctcctgccatatc

SEQ ID NO: 11067 - DNA, 31 bp, Artificial Sequence
  Primer
aaaggatccaaagaaaggcctgcttcttcac

SEQ ID NO: 11068 - DNA, 31 bp, Artificial Sequence
  Primer
aaagtcgacgaggtagaccgaacaactccag

SEQ ID NO: 11069 - DNA, 28 bp, Artificial Sequence
  Primer
aaaggatcctgccgagaatagatggggt

SEQ ID NO: 11070 - DNA, 27 bp, Artificial Sequence
  Primer
aaactcgaggatcggaaatggcaatcg

SEQ ID NO: 11071 - DNA, 28 bp, Artificial Sequence
  Primer
aaagtcgacattcgctgcggaggtagac

SEQ ID NO: 11072 - DNA, 31 bp, Artificial Sequence
  Primer
aaaggatccatagtcgaagcgtagatcgcag

SEQ ID NO: 11073 - DNA, 30 bp, Artificial Sequence
  Primer
aaaggatccagagctagcttcggagattgg

SEQ ID NO: 11074 - DNA, 29 bp, Artificial Sequence
  Primer
aaagtcgacctttgcctaaaccctcgttg

SEQ ID NO: 11075 - DNA, 30 bp, Artificial Sequence
  Primer
aaactcgagcagtggccaagtacactcacc

SEQ ID NO: 11076 - DNA, 28 bp, Artificial Sequence
  Primer
aaagtcgacctcttcccaagctccatcc

SEQ ID NO: 11077 - DNA, 30 bp, Artificial Sequence
  Primer
aaactcgagctccactcttcttctgcggtc

SEQ ID NO: 11078 - DNA, 26 bp, Artificial Sequence
  Primer
aaaggatccgaggatggaggtgggca

SEQ ID NO: 11079 - DNA, 30 bp, Artificial Sequence
  Primer
aaagtcgaccagctgagcaagacaaggaag

SEQ ID NO: 11080 - DNA, 31 bp, Artificial Sequence
  Primer
aaagtcgacagacttccagctagcagtgacc

SEQ ID NO: 11081 - DNA, 31 bp, Artificial Sequence
  Primer
aaagtcgacagggttactaggaggttgctgg

SEQ ID NO: 11082 - DNA, 31 bp, Artificial Sequence
  Primer
aaaggatccgagggagaggtcactcattcac

SEQ ID NO: 11083 - DNA, 30 bp, Artificial Sequence
  Primer
aaacccgggaatccgtaactctcgcctcac

SEQ ID NO: 11084 - DNA, 29 bp, Artificial Sequence
  Primer
aaagtcgacactgaagagtggctgcttgc

SEQ ID NO: 11085 - DNA, 27 bp, Artificial Sequence
  Primer
aaactcgagggtggttgctgagatgcc

SEQ ID NO: 11086 - DNA, 27 bp, Artificial Sequence
  Primer
aaaggatccgatgcggtgatgggaaga

SEQ ID NO: 11087 - DNA, 30 bp, Artificial Sequence
  Primer
aaaggatccaacaatatgggcttcagatgg

SEQ ID NO: 11088 - DNA, 30 bp, Artificial Sequence
  Primer
aaagtcgacaccctcttattcgtggattgg

SEQ ID NO: 11089 - DNA, 30 bp, Artificial Sequence
  Primer
aaagaattccttcgcttagcttacctgctg

SEQ ID NO: 11090 - DNA, 26 bp, Artificial Sequence
  Primer
aaaggatcctgcgtcctgcgctagct

SEQ ID NO: 11091 - DNA, 29 bp, Artificial Sequence
  Primer
aaaggatccgtatagcgtttgctcgcgtc

SEQ ID NO: 11092 - DNA, 31 bp, Artificial Sequence
  Primer
aaaggatcccgcttatctccgaatctctctc

SEQ ID NO: 11093 - DNA, 29 bp, Artificial Sequence
  Primer
aaagtcgacaagcggagcaatggagtact

SEQ ID NO: 11094 - DNA, 29 bp, Artificial Sequence
  Primer
aaactcgagcgtttctccacctccaactc

SEQ ID NO: 11095 - DNA, 26 bp, Artificial Sequence
  Primer
aaagtcgaccggccatggacaagagc

SEQ ID NO: 11096 - DNA, 30 bp, Artificial Sequence
  Primer
aaagtcgacaggatataaggctgagcggtg

SEQ ID NO: 11097 - DNA, 31 bp, Artificial Sequence
  Primer
aaagtcgacaacatcaacactgttcagccac

SEQ ID NO: 11098 - DNA, 29 bp, Artificial Sequence
  Primer
aaagtcgacgtggagcgaataagtggcag

SEQ ID NO: 11099 - DNA, 29 bp, Artificial Sequence
  Primer
aaaggatccttggttgttgcatttccttg

SEQ ID NO: 11100 - DNA, 27 bp, Artificial Sequence
  Primer
aaaggatcccaccacgacaccatgtcc

SEQ ID NO: 11101 - DNA, 30 bp, Artificial Sequence
  Primer
aaagtcgacgtcagcggaggttgttatgag

SEQ ID NO: 11102 - DNA, 29 bp, Artificial Sequence
  Primer
aaaggatccattcccgagctgttgttgtg

SEQ ID NO: 11103 - DNA, 31 bp, Artificial Sequence
  Primer
aaaggatcccaccgcaagtaagatcaaggag

SEQ ID NO: 11104 - DNA, 29 bp, Artificial Sequence
  Primer
aaaggatcctcctaatcctgccatccatc

SEQ ID NO: 11105 - DNA, 31 bp, Artificial Sequence
  Primer
aaaggatccttgcactagctcatttcccaac

SEQ ID NO: 11106 - DNA, 30 bp, Artificial Sequence
  Primer
aaagtcgacttacgatggtggacaagaatg

SEQ ID NO: 11107 - DNA, 31 bp, Artificial Sequence
  Primer
aaaggatccccattatgccaaggatttgaag

SEQ ID NO: 11108 - DNA, 31 bp, Artificial Sequence
  Primer
aaagtcgacttgttaccgaacagagggagag

SEQ ID NO: 11109 - DNA, 30 bp, Artificial Sequence
  Primer
aaaggatcctctctctgtcccgtcccatac

SEQ ID NO: 11110 - DNA, 28 bp, Artificial Sequence
  Primer
aaaggatccatttcaccaccgcttccag

SEQ ID NO: 11111 - DNA, 28 bp, Artificial Sequence
  Primer
aaaggatcccccggaactactcgaatcc

SEQ ID NO: 11112 - DNA, 31 bp, Artificial Sequence
  Primer
aaagtcgaccctcctcagatcagatctctcc

SEQ ID NO: 11113 - DNA, 31 bp, Artificial Sequence
  Primer
aaaggatcctagattgaccctgctttcctcc

SEQ ID NO: 11114 - DNA, 31 bp, Artificial Sequence
  Primer
aaactcgagtccaatcttgtcgctttctacg

SEQ ID NO: 11115 - DNA, 29 bp, Artificial Sequence
  Primer
aaaggatcctcttgaaagggcagagaagg

SEQ ID NO: 11116 - DNA, 31 bp, Artificial Sequence
  Primer
aaaggatcccaaccaaacacctgtaatcgtg

SEQ ID NO: 11117 - DNA, 31 bp, Artificial Sequence
  Primer
aaaggatccggtagaacaagagcagccagag

SEQ ID NO: 11118 - DNA, 34 bp, Artificial Sequence
  Primer
aaaggatcctcattaattagctgcagttcaaagg

SEQ ID NO: 11119 - DNA, 29 bp, Artificial Sequence
  Primer
aaaggatccccagagccacagccaataac

SEQ ID NO: 11120 - DNA, 31 bp, Artificial Sequence
  Primer
aaaggatcctaggaacggagcagaacagaac

SEQ ID NO: 11121 - DNA, 26 bp, Artificial Sequence
  Primer
aaagtcgacaatgcagcggttcgttg

SEQ ID NO: 11122 - DNA, 31 bp, Artificial Sequence
  Primer
aaaggatccgcaatatgatacgaaatgcagc

SEQ ID NO: 11123 - DNA, 31 bp, Artificial Sequence
  Primer
aaaggatccaaattgcagagagtgggaattg

SEQ ID NO: 11124 - DNA, 32 bp, Artificial Sequence
  Primer
aaagtcgaccagcacaacacaattcactaagc

SEQ ID NO: 11125 - DNA, 32 bp, Artificial Sequence
  Primer
aaagtcgactctgttctcttcaaaatggagac

SEQ ID NO: 11126 - DNA, 28 bp, Artificial Sequence
  Primer
aaaggatcccattgtctccactcgctcc

SEQ ID NO: 11127 - DNA, 31 bp, Artificial Sequence
  Primer
aaaggatccagtgtaatggccacacagagtg

SEQ ID NO: 11128 - DNA, 26 bp, Artificial Sequence
  Primer
aaagtcgaccgcagagtcaaccccac

SEQ ID NO: 11129 - DNA, 26 bp, Artificial Sequence
  Primer
aaaggatccaccccatggccttcatg

SEQ ID NO: 11130 - DNA, 29 bp, Artificial Sequence
  Primer
aaaggatccctttctgttctgcctgcctc

SEQ ID NO: 11131 - DNA, 31 bp, Artificial Sequence
  Primer
aaaggtacctagcagcattcactcgaacaag

SEQ ID NO: 11132 - DNA, 33 bp, Artificial Sequence
  Primer
tttggtaccgtagctcctcatgatcccaataag

SEQ ID NO: 11133 - DNA, 35 bp, Artificial Sequence
  Primer
aaagaattcctattgtgaactgaaagcaatgaaag

SEQ ID NO: 11134 - DNA, 31 bp, Artificial Sequence
  Primer
aaaggtaccacaggcggtttataacggaaac

SEQ ID NO: 11135 - DNA, 31 bp, Artificial Sequence
  Primer
aaaggtaccagcactttggacattcttgtcg

SEQ ID NO: 11136 - DNA, 31 bp, Artificial Sequence
  Primer
aaaaggcctggagcttcacaaagtgcttctc

SEQ ID NO: 11137 - DNA, 35 bp, Artificial Sequence
  Primer
tttggtaccttatcggttataaagccttcaagatg

SEQ ID NO: 11138 - DNA, 31 bp, Artificial Sequence
  Primer
aaaggtacctacaaggttcagcaacaccaag

SEQ ID NO: 11139 - DNA, 31 bp, Artificial Sequence
  Primer
aaaaggccttaagtgtacagcccgaaaggac

SEQ ID NO: 11140 - DNA, 31 bp, Artificial Sequence
  Primer
aaaggtaccgggtacagccaatatcaacgtc

SEQ ID NO: 11141 - DNA, 34 bp, Artificial Sequence
  Primer
aaagaattctgccaaaatgttcttagtcgtagag

SEQ ID NO: 11142 - DNA, 31 bp, Artificial Sequence
  Primer
aaaggtaccttgtgacggtcctaataactcg

SEQ ID NO: 11143 - DNA, 33 bp, Artificial Sequence
  Primer
aaaggtaccctagccgaccacgcttataatgac

SEQ ID NO: 11144 - DNA, 31 bp, Artificial Sequence
  Primer
aaagaattcttctgcgttgaactaacactgc

SEQ ID NO: 11145 - DNA, 31 bp, Artificial Sequence
  Primer
aaagaattcgcactgaactcttagcctctcg

SEQ ID NO: 11146 - DNA, 31 bp, Artificial Sequence
  Primer
aaaggtaccattgcacacacaggaagtcatc

SEQ ID NO: 11147 - DNA, 31 bp, Artificial Sequence
  Primer
aaaaggcctggcctagagtacagggaagagg

SEQ ID NO: 11148 - DNA, 34 bp, Artificial Sequence
  Primer
aaaggtaccctatatgatctcaaatgggttgtgg

SEQ ID NO: 11149 - DNA, 32 bp, Artificial Sequence
  Primer
aaaggtacctgatacaacctcaaacccatacg

SEQ ID NO: 11150 - DNA, 30 bp, Artificial Sequence
  Primer
aaaggtaccccaagaaatggcgtcctactc

SEQ ID NO: 11151 - DNA, 31 bp, Artificial Sequence
  Primer
aaaggtaccaagcgacagctttaggcaatac

SEQ ID NO: 11152 - DNA, 28 bp, Artificial Sequence
  Primer
tttggtacctatccgtctacgcaccgct

SEQ ID NO: 11153 - DNA, 31 bp, Artificial Sequence
  Primer
aaaggtaccggactaatggctgactgagagc

SEQ ID NO: 11154 - DNA, 31 bp, Artificial Sequence
  Primer
aaaaggcctgaaaactagtacatgcggctgg

SEQ ID NO: 11155 - DNA, 34 bp, Artificial Sequence
  Primer
aaaggtaccctaatggtccgtcaagtacaaggtc

SEQ ID NO: 11156 - DNA, 34 bp, Artificial Sequence
  Primer
aaaggtaccctatggcacttgtctaattctgacg

SEQ ID NO: 11157 - DNA, 34 bp, Artificial Sequence
  Primer
aaaggtaccctagactcgactagcaagcaacacc

SEQ ID NO: 11158 - DNA, 31 bp, Artificial Sequence
  Primer
aaaggtaccctaactcgactgctgcaacctg

SEQ ID NO: 11159 - DNA, 31 bp, Artificial Sequence
  Primer
aaagaattcacaaacattcatccacagggag

SEQ ID NO: 11160 - DNA, 31 bp, Artificial Sequence
  Primer
aaaggtacctcactagtcacaccttcgttcg

SEQ ID NO: 11161 - DNA, 33 bp, Artificial Sequence
  Primer
tttgaattcttactagaactccaccacgaggct

SEQ ID NO: 11162 - DNA, 31 bp, Artificial Sequence
  Primer
aaaggatccaacgaccactaaatcgaccaac

SEQ ID NO: 11163 - DNA, 31 bp, Artificial Sequence
  Primer
aaaggtaccagacagcatagaaccgacatcc

SEQ ID NO: 11164 - DNA, 29 bp, Artificial Sequence
  Primer
tttggtaccccaaactccggatcaaagag

SEQ ID NO: 11165 - DNA, 31 bp, Artificial Sequence
  Primer
aaagaattcaaacagtacaaaggctgcttgg

SEQ ID NO: 11166 - DNA, 31 bp, Artificial Sequence
  Primer
aaagagctcaacacctccgaagaaaggaaag

SEQ ID NO: 11167 - DNA, 31 bp, Artificial Sequence
  Primer
aaagaattcagtcctccgtgaataaacaacg

SEQ ID NO: 11168 - DNA, 31 bp, Artificial Sequence
  Primer
aaagaattccatcatctgggattaaccttgc

SEQ ID NO: 11169 - DNA, 30 bp, Artificial Sequence
  Primer
aaaggtaccgaccacgcttatcagcttctc

SEQ ID NO: 11170 - DNA, 34 bp, Artificial Sequence
  Primer
aaaaggcctctatcataaacaatgcaatgggttc

SEQ ID NO: 11171 - DNA, 31 bp, Artificial Sequence
  Primer
aaaggatcccagaatcagcatcctcttcctc

SEQ ID NO: 11172 - DNA, 31 bp, Artificial Sequence
  Primer
aaaaggcctaccgctgctatacaaaccaatc

SEQ ID NO: 11173 - DNA, 30 bp, Artificial Sequence
  Primer
aaaggtaccagcagcatcagaattgcactc

SEQ ID NO: 11174 - DNA, 40 bp, Artificial Sequence
  Primer
tttggtaccaccgtattagtgaagtcctcctagttagtac

SEQ ID NO: 11175 - DNA, 32 bp, Artificial Sequence
  Primer
aaagatatcaatccaagttcagggatatgagc

SEQ ID NO: 11176 - DNA, 34 bp, Artificial Sequence
  Primer
aaagaattcctaagttacactcgcttcacgcttc

SEQ ID NO: 11177 - DNA, 32 bp, Artificial Sequence
  Primer
tttggtaccagtgcttcaccttcttcttttcc

SEQ ID NO: 11178 - DNA, 31 bp, Artificial Sequence
  Primer
aaaggtaccattcccatgatggatgacaaac

SEQ ID NO: 11179 - DNA, 29 bp, Artificial Sequence
  Primer
aaaggtaccccaacattagcctacgccac

SEQ ID NO: 11180 - DNA, 31 bp, Artificial Sequence
  Primer
aaaggtaccagatgcatgggtgtgttctatg

SEQ ID NO: 11181 - DNA, 33 bp, Artificial Sequence
  Primer
aaaaggcctctaaactgttccttccttccatcc

SEQ ID NO: 11182 - DNA, 33 bp, Artificial Sequence
  Primer
tttggtaccgtgttacagtgctcaagaattggc

SEQ ID NO: 11183 - DNA, 31 bp, Artificial Sequence
  Primer
aaaaggcctcctcagtgagatgatggtttcc

SEQ ID NO: 11184 - DNA, 31 bp, Artificial Sequence
  Primer
aaaggtacctcttgttcgatcctgtgaaatg

SEQ ID NO: 11185 - DNA, 34 bp, Artificial Sequence
  Primer
aaaggtaccctatttattcctccacatctgcacc

SEQ ID NO: 11186 - DNA, 31 bp, Artificial Sequence
  Primer
aaaggatccaacttgacaccaacacatcctg

SEQ ID NO: 11187 - DNA, 31 bp, Artificial Sequence
  Primer
aaaaggcctaccgtcatatacacagcactcg

SEQ ID NO: 11188 - DNA, 31 bp, Artificial Sequence
  Primer
aaagaattcaactcggtcggtcacatatctc

SEQ ID NO: 11189 - DNA, 30 bp, Artificial Sequence
  Primer
aaagaattcctccgtgctatctgtcctgag

SEQ ID NO: 11190 - DNA, 31 bp, Artificial Sequence
  Primer
aaagaattcgcactgctacacatttcaccac

SEQ ID NO: 11191 - DNA, 31 bp, Artificial Sequence
  Primer
aaaggtaccacaattcgtgaagtttggatgg

SEQ ID NO: 11192 - DNA, 31 bp, Artificial Sequence
  Primer
aaaggatccaacaggccactttaccctaagc

SEQ ID NO: 11193 - DNA, 35 bp, Artificial Sequence
  Primer
aaagaattcctattccatgagctcagtatccagac

SEQ ID NO: 11194 - DNA, 31 bp, Artificial Sequence
  Primer
aaaggtaccaatatcgctcataccatggacc

SEQ ID NO: 11195 - DNA, 31 bp, Artificial Sequence
  Primer
aaagaattccaaccttggaggaatctgaaag

SEQ ID NO: 11196 - DNA, 32 bp, Artificial Sequence
  Primer
aaaggtaccactgccatggctataaactcagg

SEQ ID NO: 11197 - DNA, 32 bp, Artificial Sequence
  Primer
aaaggtaccctttatgagcaacgcatatcacc

SEQ ID NO: 11198 - DNA, 30 bp, Artificial Sequence
  Primer
aaaggtaccgcttattggtcaagttcgacg

SEQ ID NO: 11199 - DNA, 31 bp, Artificial Sequence
  Primer
aaaggtaccatgaatgcgaacaactgaacac

SEQ ID NO: 11200 - DNA, 31 bp, Artificial Sequence
  Primer
aaaggatccttccattacagcacaggtattg

SEQ ID NO: 11201 - DNA, 31 bp, Artificial Sequence
  Primer
aaaggtaccatactagcaacacactggcagc

SEQ ID NO: 11202 - DNA, 31 bp, Artificial Sequence
  Primer
aaaggatcctacaaactcccatgaactcagc

SEQ ID NO: 11203 - DNA, 31 bp, Artificial Sequence
  Primer
aaagaattcatgagcacaccaccttatctgc

SEQ ID NO: 11204 - DNA, 34 bp, Artificial Sequence
  Primer
aaaggtacctcaacagggatgcgacataattgac

SEQ ID NO: 11205 - DNA, 31 bp, Artificial Sequence
  Primer
aaaggtaccaagggatgtcattctcatgtgg

SEQ ID NO: 11206 - DNA, 31 bp, Artificial Sequence
  Primer
aaaggtaccgttgtttcacgcatgtagttgg

SEQ ID NO: 11207 - DNA, 33 bp, Artificial Sequence
  Primer
aaaaggcctacatttgtttgtccttcactgttc

SEQ ID NO: 11208 - DNA, 31 bp, Artificial Sequence
  Primer
aaaggtacctgcaagaatcaagatggtgttg

SEQ ID NO: 11209 - DNA, 31 bp, Artificial Sequence
  Primer
aaaaggcctcaacaaatgccctaaggacaag

SEQ ID NO: 11210 - DNA, 31 bp, Artificial Sequence
  Primer
aaaggtacccggcatacatgaactgaatcac

SEQ ID NO: 11211 - DNA, 31 bp, Artificial Sequence
  Primer
aaaggatccacgttatcctggtcaacctcac

SEQ ID NO: 11212 - DNA, 31 bp, Artificial Sequence
  Primer
aaaggtaccacatgcattcgccaagatactc

SEQ ID NO: 11213 - DNA, 31 bp, Artificial Sequence
  Primer
aaaggtacctatgccaaagctgctacagttg

SEQ ID NO: 11214 - DNA, 31 bp, Artificial Sequence
  Primer
tttggtacctcttggtcatcttttccatgag

SEQ ID NO: 11215 - DNA, 34 bp, Artificial Sequence
  Primer
aaaggtaccctaatgaacagcagaggaacagacg

SEQ ID NO: 11216 - DNA, 31 bp, Artificial Sequence
  Primer
aaaggtacctacagattcctcgacttccagc

SEQ ID NO: 11217 - DNA, 27 bp, Artificial Sequence
  Primer
tttaggcctactgagcatcccagcaag

SEQ ID NO: 11218 - DNA, 31 bp, Artificial Sequence
  Primer
aaaggtaccagtatccgcagccatctctatc

SEQ ID NO: 11219 - DNA, 31 bp, Artificial Sequence
  Primer
aaaggtacctacacattcatgtgcaaagcag

SEQ ID NO: 11220 - DNA, 31 bp, Artificial Sequence
  Primer
aaaggatcccagcaggttaacaaggaccatc

SEQ ID NO: 11221 - DNA, 31 bp, Artificial Sequence
  Primer
aaagaattcaatgattggtattgccattagg

SEQ ID NO: 11222 - DNA, 34 bp, Artificial Sequence
  Primer
aaaggtacccaacattcacagaactagtcattgg

SEQ ID NO: 11223 - DNA, 31 bp, Artificial Sequence
  Primer
aaaggtaccatcgaagcactatggtgagagc

SEQ ID NO: 11224 - DNA, 30 bp, Artificial Sequence
  Primer
tttggtaccttacgtcgcttatgagtcgca

SEQ ID NO: 11225 - DNA, 33 bp, Artificial Sequence
  Primer
aaaggatcctcaaatctcaaagctgtgacgtcc

SEQ ID NO: 11226 - DNA, 29 bp, Artificial Sequence
  Primer
aaaggtacccaacagcattaccacggaca

SEQ ID NO: 11227 - DNA, 31 bp, Artificial Sequence
  Primer
aaaggtaccagtcctgcagatcaactcattg
